United States Patent 12,097,253 (RSV RNA MOLECULES AND COMPOSITIONS FOR VACCINATION) - sequence listing, part 14

SEQ ID NO: 19185 - RNA, 1951 nt, synthetic construct
  misc_feature 1..1951: note = mRNA product Design b-4 comprising derived and/or modified sequence from HRSV(Memphis-37)__AIY60640.1__F_DSCav1_mut8 (opt6)
  source 1..1951: mol_type = other RNA
gggagagtcccgcagtcggcgtccagcggctctgcttgttcgtgtgtgtgtcgttgcaggccttattcaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19186 - RNA, 1951 nt, synthetic construct
  misc_feature 1..1951: note = mRNA product Design b-4 comprising derived and/or modified sequence from HRSV(Memphis-37)__AIY60640.1__F_DSCav1_mut8 (opt11)
  source 1..1951: mol_type = other RNA
gggagagtcccgcagtcggcgtccagcggctctgcttgttcgtgtgtgtgtcgttgcaggccttattcaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19187 - RNA, 2013 nt, synthetic construct
  misc_feature 1..2013: note = mRNA product Design b-5 comprising derived and/or modified sequence from HRSV(Memphis-37)__AIY60640.1__F_DSCav1_mut8 (opt1)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19188 - RNA, 2013 nt, synthetic construct
  misc_feature 1..2013: note = mRNA product Design b-5 comprising derived and/or modified sequence from HRSV(Memphis-37)__AIY60640.1__F_DSCav1_mut8 (opt1)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19189 - RNA, 2013 nt, synthetic construct
  misc_feature 1..2013: note = mRNA product Design b-5 comprising derived and/or modified sequence from HRSV(Memphis-37)__AIY60640.1__F_DSCav1_mut8 (opt2)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19190 - RNA, 2013 nt, synthetic construct
  misc_feature 1..2013: note = mRNA product Design b-5 comprising derived and/or modified sequence from HRSV(Memphis-37)__AIY60640.1__F_DSCav1_mut8 (opt3)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19191 - RNA, 2013 nt, synthetic construct
  misc_feature 1..2013: note = mRNA product Design b-5 comprising derived and/or modified sequence from HRSV(Memphis-37)__AIY60640.1__F_DSCav1_mut8 (opt4)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19192 - RNA, 2013 nt, synthetic construct
  misc_feature 1..2013: note = mRNA product Design b-5 comprising derived and/or modified sequence from HRSV(Memphis-37)__AIY60640.1__F_DSCav1_mut8 (opt5)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19193 - RNA, 2013 nt, synthetic construct
  misc_feature 1..2013: note = mRNA product Design b-5 comprising derived and/or modified sequence from HRSV(Memphis-37)__AIY60640.1__F_DSCav1_mut8 (opt6)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19194 - RNA, 2013 nt, synthetic construct
  misc_feature 1..2013: note = mRNA product Design b-5 comprising derived and/or modified sequence from HRSV(Memphis-37)__AIY60640.1__F_DSCav1_mut8 (opt11)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19195 - RNA, 1919 nt, synthetic construct
  misc_feature 1..1919: note = mRNA product Design c-1 comprising derived and/or modified sequence from HRSV(Memphis-37)__AIY60640.1__F_DSCav1_mut8 (opt1)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19196 - RNA, 1919 nt, synthetic construct
  misc_feature 1..1919: note = mRNA product Design c-1 comprising derived and/or modified sequence from HRSV(Memphis-37)__AIY60640.1__F_DSCav1_mut8 (opt1)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19197 - RNA, 1919 nt, synthetic construct
  misc_feature 1..1919: note = mRNA product Design c-1 comprising derived and/or modified sequence from HRSV(Memphis-37)__AIY60640.1__F_DSCav1_mut8 (opt2)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19198 - RNA, 1919 nt, synthetic construct
  misc_feature 1..1919: note = mRNA product Design c-1 comprising derived and/or modified sequence from HRSV(Memphis-37)__AIY60640.1__F_DSCav1_mut8 (opt3)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19199 - RNA, 1919 nt, synthetic construct
  misc_feature 1..1919: note = mRNA product Design c-1 comprising derived and/or modified sequence from HRSV(Memphis-37)__AIY60640.1__F_DSCav1_mut8 (opt4)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19200 - RNA, 1919 nt, synthetic construct
  misc_feature 1..1919: note = mRNA product Design c-1 comprising derived and/or modified sequence from HRSV(Memphis-37)__AIY60640.1__F_DSCav1_mut8 (opt5)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19201 - RNA, 1919 nt, synthetic construct
  misc_feature 1..1919: note = mRNA product Design c-1 comprising derived and/or modified sequence from HRSV(Memphis-37)__AIY60640.1__F_DSCav1_mut8 (opt6)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19202 - RNA, 1919 nt, synthetic construct
  misc_feature 1..1919: note = mRNA product Design c-1 comprising derived and/or modified sequence from HRSV(Memphis-37)__AIY60640.1__F_DSCav1_mut8 (opt11)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19203 - RNA, 2009 nt, synthetic construct
  misc_feature 1..2009: note = mRNA product Design c-2 comprising derived and/or modified sequence from HRSV(Memphis-37)__AIY60640.1__F_DSCav1_mut8 (opt1)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19204 - RNA, 2009 nt, synthetic construct
  misc_feature 1..2009: note = mRNA product Design c-2 comprising derived and/or modified sequence from HRSV(Memphis-37)__AIY60640.1__F_DSCav1_mut8 (opt1)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19205 - RNA, 2009 nt, synthetic construct
  misc_feature 1..2009: note = mRNA product Design c-2 comprising derived and/or modified sequence from HRSV(Memphis-37)__AIY60640.1__F_DSCav1_mut8 (opt2)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19206 - RNA, 2009 nt, synthetic construct
  misc_feature 1..2009: note = mRNA product Design c-2 comprising derived and/or modified sequence from HRSV(Memphis-37)__AIY60640.1__F_DSCav1_mut8 (opt3)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19207 - RNA, 2009 nt, synthetic construct
  misc_feature 1..2009: note = mRNA product Design c-2 comprising derived and/or modified sequence from HRSV(Memphis-37)__AIY60640.1__F_DSCav1_mut8 (opt4)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19208 - RNA, 2009 nt, synthetic construct
  misc_feature 1..2009: note = mRNA product Design c-2 comprising derived and/or modified sequence from HRSV(Memphis-37)__AIY60640.1__F_DSCav1_mut8 (opt5)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19209 - RNA, 2009 nt, synthetic construct
  misc_feature 1..2009: note = mRNA product Design c-2 comprising derived and/or modified sequence from HRSV(Memphis-37)__AIY60640.1__F_DSCav1_mut8 (opt6)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19210 - RNA, 2009 nt, synthetic construct
  misc_feature 1..2009: note = mRNA product Design c-2 comprising derived and/or modified sequence from HRSV(Memphis-37)__AIY60640.1__F_DSCav1_mut8 (opt11)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19211 - RNA, 1986 nt, synthetic construct
  misc_feature 1..1986: note = mRNA product Design c-3 comprising derived and/or modified sequence from HRSV(Memphis-37)__AIY60640.1__F_DSCav1_mut8 (opt1)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19212 - RNA, 1986 nt, synthetic construct
  misc_feature 1..1986: note = mRNA product Design c-3 comprising derived and/or modified sequence from HRSV(Memphis-37)__AIY60640.1__F_DSCav1_mut8 (opt1)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19213 - RNA, 1986 nt, synthetic construct
  misc_feature 1..1986: note = mRNA product Design c-3 comprising derived and/or modified sequence from HRSV(Memphis-37)__AIY60640.1__F_DSCav1_mut8 (opt2)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19214 - RNA, 1986 nt, synthetic construct
  misc_feature 1..1986: note = mRNA product Design c-3 comprising derived and/or modified sequence from HRSV(Memphis-37)__AIY60640.1__F_DSCav1_mut8 (opt3)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19215 - RNA, 1986 nt, synthetic construct
  misc_feature 1..1986: note = mRNA product Design c-3 comprising derived and/or modified sequence from HRSV(Memphis-37)__AIY60640.1__F_DSCav1_mut8 (opt4)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19216 - RNA, 1986 nt, synthetic construct
  misc_feature 1..1986: note = mRNA product Design c-3 comprising derived and/or modified sequence from HRSV(Memphis-37)__AIY60640.1__F_DSCav1_mut8 (opt5)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19217 - RNA, 1986 nt, synthetic construct
  misc_feature 1..1986: note = mRNA product Design c-3 comprising derived and/or modified sequence from HRSV(Memphis-37)__AIY60640.1__F_DSCav1_mut8 (opt6)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19218 - RNA, 1986 nt, synthetic construct
  misc_feature 1..1986: note = mRNA product Design c-3 comprising derived and/or modified sequence from HRSV(Memphis-37)__AIY60640.1__F_DSCav1_mut8 (opt11)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19219 - RNA, 1982 nt, synthetic construct
  misc_feature 1..1982: note = mRNA product Design c-4 comprising derived and/or modified sequence from HRSV(Memphis-37)__AIY60640.1__F_DSCav1_mut8 (opt1)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19220 - RNA, 1982 nt, synthetic construct
  misc_feature 1..1982: note = mRNA product Design c-4 comprising derived and/or modified sequence from HRSV(Memphis-37)__AIY60640.1__F_DSCav1_mut8 (opt1)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19221 - RNA, 1982 nt, synthetic construct
  misc_feature 1..1982: note = mRNA product Design c-4 comprising derived and/or modified sequence from HRSV(Memphis-37)__AIY60640.1__F_DSCav1_mut8 (opt2)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19222 - RNA, 1982 nt, synthetic construct
  misc_feature 1..1982: note = mRNA product Design c-4 comprising derived and/or modified sequence from HRSV(Memphis-37)__AIY60640.1__F_DSCav1_mut8 (opt3)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19223 - RNA, 1982 nt, synthetic construct
  misc_feature 1..1982: note = mRNA product Design c-4 comprising derived and/or modified sequence from HRSV(Memphis-37)__AIY60640.1__F_DSCav1_mut8 (opt4)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19224 - RNA, 1982 nt, synthetic construct
  misc_feature 1..1982: note = mRNA product Design c-4 comprising derived and/or modified sequence from HRSV(Memphis-37)__AIY60640.1__F_DSCav1_mut8 (opt5)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19225 - RNA, 1982 nt, synthetic construct
  misc_feature 1..1982: note = mRNA product Design c-4 comprising derived and/or modified sequence from HRSV(Memphis-37)__AIY60640.1__F_DSCav1_mut8 (opt6)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19226 - RNA, 1982 nt, synthetic construct
  misc_feature 1..1982: note = mRNA product Design c-4 comprising derived and/or modified sequence from HRSV(Memphis-37)__AIY60640.1__F_DSCav1_mut8 (opt11)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19227 - RNA, 1900 nt, synthetic construct
  misc_feature 1..1900: note = mRNA product Design c-5 comprising derived and/or modified sequence from HRSV(Memphis-37)__AIY60640.1__F_DSCav1_mut8 (opt1)
  source 1..1900: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19228 - RNA, 1900 nt, synthetic construct
  misc_feature 1..1900: note = mRNA product Design c-5 comprising derived and/or modified sequence from HRSV(Memphis-37)__AIY60640.1__F_DSCav1_mut8 (opt1)
  source 1..1900: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19229 - RNA, 1900 nt, synthetic construct
  misc_feature 1..1900: note = mRNA product Design c-5 comprising derived and/or modified sequence from HRSV(Memphis-37)__AIY60640.1__F_DSCav1_mut8 (opt2)
  source 1..1900: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19230 - RNA, 1900 nt, synthetic construct
  misc_feature 1..1900: note = mRNA product Design c-5 comprising derived and/or modified sequence from HRSV(Memphis-37)__AIY60640.1__F_DSCav1_mut8 (opt3)
  source 1..1900: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19231 - RNA, 1900 nt, synthetic construct
  misc_feature 1..1900: note = mRNA product Design c-5 comprising derived and/or modified sequence from HRSV(Memphis-37)__AIY60640.1__F_DSCav1_mut8 (opt4)
  source 1..1900: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19232 - RNA, 1900 nt, synthetic construct
  misc_feature 1..1900: note = mRNA product Design c-5 comprising derived and/or modified sequence from HRSV(Memphis-37)__AIY60640.1__F_DSCav1_mut8 (opt5)
  source 1..1900: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19233 - RNA, 1900 nt, synthetic construct
  misc_feature 1..1900: note = mRNA product Design c-5 comprising derived and/or modified sequence from HRSV(Memphis-37)__AIY60640.1__F_DSCav1_mut8 (opt6)
  source 1..1900: mol_type = other RNA
gggagagcggctcggccattttgtcccagtcagtccggaggctgcggctgcagaagtaccgcctgcggagtaactgcaaagaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19234 - RNA, 1900 nt, synthetic construct
  misc_feature 1..1900: note = mRNA product Design c-5 comprising derived and/or modified sequence from HRSV(Memphis-37)__AIY60640.1__F_DSCav1_mut8 (opt11)
  source 1..1900: mol_type = other RNA
gggagagcggctcggccattttgtcccagtcagtccggaggctgcggctgcagaagtaccgcctgcggagtaactgcaaagaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19235 - RNA, 1909 nt, synthetic construct
  misc_feature 1..1909: note = mRNA product Design d-1 comprising derived and/or modified sequence from HRSV(Memphis-37)__AIY60640.1__F_DSCav1_mut8 (opt1)
  source 1..1909: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19236 - RNA, 1909 nt, synthetic construct
  misc_feature 1..1909: note = mRNA product Design d-1 comprising derived and/or modified sequence from HRSV(Memphis-37)__AIY60640.1__F_DSCav1_mut8 (opt1)
  source 1..1909: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19237 - RNA, 1909 nt, synthetic construct
  misc_feature 1..1909: note = mRNA product Design d-1 comprising derived and/or modified sequence from HRSV(Memphis-37)__AIY60640.1__F_DSCav1_mut8 (opt2)
  source 1..1909: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19238 - RNA, 1909 nt, synthetic construct
  misc_feature 1..1909: note = mRNA product Design d-1 comprising derived and/or modified sequence from HRSV(Memphis-37)__AIY60640.1__F_DSCav1_mut8 (opt3)
  source 1..1909: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19239 - RNA, 1909 nt, synthetic construct
  misc_feature 1..1909: note = mRNA product Design d-1 comprising derived and/or modified sequence from HRSV(Memphis-37)__AIY60640.1__F_DSCav1_mut8 (opt4)
  source 1..1909: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19240 - RNA, 1909 nt, synthetic construct
  misc_feature 1..1909: note = mRNA product Design d-1 comprising derived and/or modified sequence from HRSV(Memphis-37)__AIY60640.1__F_DSCav1_mut8 (opt5)
  source 1..1909: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19241 - RNA, 1909 nt, synthetic construct
  misc_feature 1..1909: note = mRNA product Design d-1 comprising derived and/or modified sequence from HRSV(Memphis-37)__AIY60640.1__F_DSCav1_mut8 (opt6)
  source 1..1909: mol_type = other RNA
gggagacccgtgacccggaagttgtacggctacgcgactttccctcccacaaaccctcgcgcccttcctttcctacttgggcccggcagaaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19242 - RNA, 1909 nt, synthetic construct
  misc_feature 1..1909: note = mRNA product Design d-1 comprising derived and/or modified sequence from HRSV(Memphis-37)__AIY60640.1__F_DSCav1_mut8 (opt11)
  source 1..1909: mol_type = other RNA
gggagacccgtgacccggaagttgtacggctacgcgactttccctcccacaaaccctcgcgcccttcctttcctacttgggcccggcagaaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19243 - RNA, 1964 nt, synthetic construct
  misc_feature 1..1964: note = mRNA product Design d-2 comprising derived and/or modified sequence from HRSV(Memphis-37)__AIY60640.1__F_DSCav1_mut8 (opt1)
  source 1..1964: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19244 - RNA, 1964 nt, synthetic construct
  misc_feature 1..1964: note = mRNA product Design d-2 comprising derived and/or modified sequence from HRSV(Memphis-37)__AIY60640.1__F_DSCav1_mut8 (opt1)
  source 1..1964: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19245 - RNA, 1964 nt, synthetic construct
  misc_feature 1..1964: note = mRNA product Design d-2 comprising derived and/or modified sequence from HRSV(Memphis-37)__AIY60640.1__F_DSCav1_mut8 (opt2)
  source 1..1964: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19246 - RNA, 1964 nt, synthetic construct
  misc_feature 1..1964: note = mRNA product Design d-2 comprising derived and/or modified sequence from HRSV(Memphis-37)__AIY60640.1__F_DSCav1_mut8 (opt3)
  source 1..1964: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19247 - RNA, 1964 nt, synthetic construct
  misc_feature 1..1964: note = mRNA product Design d-2 comprising derived and/or modified sequence from HRSV(Memphis-37)__AIY60640.1__F_DSCav1_mut8 (opt4)
  source 1..1964: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19248 - RNA, 1964 nt, synthetic construct
  misc_feature 1..1964: note = mRNA product Design d-2 comprising derived and/or modified sequence from HRSV(Memphis-37)__AIY60640.1__F_DSCav1_mut8 (opt5)
  source 1..1964: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19249 - RNA, 1964 nt, synthetic construct
  misc_feature 1..1964: note = mRNA product Design d-2 comprising derived and/or modified sequence from HRSV(Memphis-37)__AIY60640.1__F_DSCav1_mut8 (opt6)
  source 1..1964: mol_type = other RNA
gggagagcggctcggccattttgtcccagtcagtccggaggctgcggctgcagaagtaccgcctgcggagtaactgcaaagaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19250 - RNA, 1964 nt, synthetic construct
  misc_feature 1..1964: note = mRNA product Design d-2 comprising derived and/or modified sequence from HRSV(Memphis-37)__AIY60640.1__F_DSCav1_mut8 (opt11)
  source 1..1964: mol_type = other RNA
gggagagcggctcggccattttgtcccagtcagtccggaggctgcggctgcagaagtaccgcctgcggagtaactgcaaagaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19251 - RNA, 2280 nt, synthetic construct
  misc_feature 1..2280: note = mRNA product Design d-3 comprising derived and/or modified sequence from HRSV(Memphis-37)__AIY60640.1__F_DSCav1_mut8 (opt1)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19252 - RNA, 2280 nt, synthetic construct
  misc_feature 1..2280: note = mRNA product Design d-3 comprising derived and/or modified sequence from HRSV(Memphis-37)__AIY60640.1__F_DSCav1_mut8 (opt1)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19253 - RNA, 2280 nt, synthetic construct
  misc_feature 1..2280: note = mRNA product Design d-3 comprising derived and/or modified sequence from HRSV(Memphis-37)__AIY60640.1__F_DSCav1_mut8 (opt2)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19254 - RNA, 2280 nt, synthetic construct
  misc_feature 1..2280: note = mRNA product Design d-3 comprising derived and/or modified sequence from HRSV(Memphis-37)__AIY60640.1__F_DSCav1_mut8 (opt3)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19255 - RNA, 2280 nt, synthetic construct
  misc_feature 1..2280: note = mRNA product Design d-3 comprising derived and/or modified sequence from HRSV(Memphis-37)__AIY60640.1__F_DSCav1_mut8 (opt4)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19256 - RNA, 2280 nt, synthetic construct
  misc_feature 1..2280: note = mRNA product Design d-3 comprising derived and/or modified sequence from HRSV(Memphis-37)__AIY60640.1__F_DSCav1_mut8 (opt5)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19257 - RNA, 2280 nt, synthetic construct
  misc_feature 1..2280: note = mRNA product Design d-3 comprising derived and/or modified sequence from HRSV(Memphis-37)__AIY60640.1__F_DSCav1_mut8 (opt6)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19258 - RNA, 2280 nt, synthetic construct
  misc_feature 1..2280: note = mRNA product Design d-3 comprising derived and/or modified sequence from HRSV(Memphis-37)__AIY60640.1__F_DSCav1_mut8 (opt11)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19259 - RNA, 1963 nt, synthetic construct
  misc_feature 1..1963: note = mRNA product Design d-4 comprising derived and/or modified sequence from HRSV(Memphis-37)__AIY60640.1__F_DSCav1_mut8 (opt1)
  source 1..1963: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19260 - RNA, 1963 nt, synthetic construct
  misc_feature 1..1963: note = mRNA product Design d-4 comprising derived and/or modified sequence from HRSV(Memphis-37)__AIY60640.1__F_DSCav1_mut8 (opt1)
  source 1..1963: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19261 - RNA, 1963 nt, synthetic construct
  misc_feature 1..1963: note = mRNA product Design d-4 comprising derived and/or modified sequence from HRSV(Memphis-37)__AIY60640.1__F_DSCav1_mut8 (opt2)
  source 1..1963: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19262 - RNA, 1963 nt, synthetic construct
  misc_feature 1..1963: note = mRNA product Design d-4 comprising derived and/or modified sequence from HRSV(Memphis-37)__AIY60640.1__F_DSCav1_mut8 (opt3)
  source 1..1963: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19263 - RNA, 1963 nt, synthetic construct
  misc_feature 1..1963: note = mRNA product Design d-4 comprising derived and/or modified sequence from HRSV(Memphis-37)__AIY60640.1__F_DSCav1_mut8 (opt4)
  source 1..1963: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19264 - RNA, 1963 nt, synthetic construct
  misc_feature 1..1963: note = mRNA product Design d-4 comprising derived and/or modified sequence from HRSV(Memphis-37)__AIY60640.1__F_DSCav1_mut8 (opt5)
  source 1..1963: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19265 - RNA, 1963 nt, synthetic construct
  misc_feature 1..1963: note = mRNA product Design d-4 comprising derived and/or modified sequence from HRSV(Memphis-37)__AIY60640.1__F_DSCav1_mut8 (opt6)
  source 1..1963: mol_type = other RNA
gggagagtcccgcagtcggcgtccagcggctctgcttgttcgtgtgtgtgtcgttgcaggccttattcaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19266 - RNA, 1963 nt, synthetic construct
  misc_feature 1..1963: note = mRNA product Design d-4 comprising derived and/or modified sequence from HRSV(Memphis-37)__AIY60640.1__F_DSCav1_mut8 (opt11)
  source 1..1963: mol_type = other RNA
gggagagtcccgcagtcggcgtccagcggctctgcttgttcgtgtgtgtgtcgttgcaggccttattcaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19267 - RNA, 2060 nt, synthetic construct
  misc_feature 1..2060: note = mRNA product Design d-5 comprising derived and/or modified sequence from HRSV(Memphis-37)__AIY60640.1__F_DSCav1_mut8 (opt1)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19268 - RNA, 2060 nt, synthetic construct
  misc_feature 1..2060: note = mRNA product Design d-5 comprising derived and/or modified sequence from HRSV(Memphis-37)__AIY60640.1__F_DSCav1_mut8 (opt1)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19269 - RNA, 2060 nt, synthetic construct
  misc_feature 1..2060: note = mRNA product Design d-5 comprising derived and/or modified sequence from HRSV(Memphis-37)__AIY60640.1__F_DSCav1_mut8 (opt2)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19270 - RNA, 2060 nt, synthetic construct
  misc_feature 1..2060: note = mRNA product Design d-5 comprising derived and/or modified sequence from HRSV(Memphis-37)__AIY60640.1__F_DSCav1_mut8 (opt3)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19271 - RNA, 2060 nt, synthetic construct
  misc_feature 1..2060: note = mRNA product Design d-5 comprising derived and/or modified sequence from HRSV(Memphis-37)__AIY60640.1__F_DSCav1_mut8 (opt4)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19272 - RNA, 2060 nt, synthetic construct
  misc_feature 1..2060: note = mRNA product Design d-5 comprising derived and/or modified sequence from HRSV(Memphis-37)__AIY60640.1__F_DSCav1_mut8 (opt5)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19273 - RNA, 2060 nt, synthetic construct
  misc_feature 1..2060: note = mRNA product Design d-5 comprising derived and/or modified sequence from HRSV(Memphis-37)__AIY60640.1__F_DSCav1_mut8 (opt6)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19274 - RNA, 2060 nt, synthetic construct
  misc_feature 1..2060: note = mRNA product Design d-5 comprising derived and/or modified sequence from HRSV(Memphis-37)__AIY60640.1__F_DSCav1_mut8 (opt11)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19275 - RNA, 1940 nt, synthetic construct
  misc_feature 1..1940: note = mRNA product Design e-1 comprising derived and/or modified sequence from HRSV(Memphis-37)__AIY60640.1__F_DSCav1_mut8 (opt1)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19276 - RNA, 1940 nt, synthetic construct
  misc_feature 1..1940: note = mRNA product Design e-1 comprising derived and/or modified sequence from HRSV(Memphis-37)__AIY60640.1__F_DSCav1_mut8 (opt1)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19277 - RNA, 1940 nt, synthetic construct
  misc_feature 1..1940: note = mRNA product Design e-1 comprising derived and/or modified sequence from HRSV(Memphis-37)__AIY60640.1__F_DSCav1_mut8 (opt2)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19278 - RNA, 1940 nt, synthetic construct
  misc_feature 1..1940: note = mRNA product Design e-1 comprising derived and/or modified sequence from HRSV(Memphis-37)__AIY60640.1__F_DSCav1_mut8 (opt3)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19279 - RNA, 1940 nt, synthetic construct
  misc_feature 1..1940: note = mRNA product Design e-1 comprising derived and/or modified sequence from HRSV(Memphis-37)__AIY60640.1__F_DSCav1_mut8 (opt4)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19280 - RNA, 1940 nt, synthetic construct
  misc_feature 1..1940: note = mRNA product Design e-1 comprising derived and/or modified sequence from HRSV(Memphis-37)__AIY60640.1__F_DSCav1_mut8 (opt5)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19281 - RNA, 1940 nt, synthetic construct
  misc_feature 1..1940: note = mRNA product Design e-1 comprising derived and/or modified sequence from HRSV(Memphis-37)__AIY60640.1__F_DSCav1_mut8 (opt6)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19282 - RNA, 1940 nt, synthetic construct
  misc_feature 1..1940: note = mRNA product Design e-1 comprising derived and/or modified sequence from HRSV(Memphis-37)__AIY60640.1__F_DSCav1_mut8 (opt11)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19283 - RNA, 1922 nt, synthetic construct
  misc_feature 1..1922: note = mRNA product Design e-2 comprising derived and/or modified sequence from HRSV(Memphis-37)__AIY60640.1__F_DSCav1_mut8 (opt1)
  source 1..1922: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19284 - RNA, 1922 nt, synthetic construct
  misc_feature 1..1922: note = mRNA product Design e-2 comprising derived and/or modified sequence from HRSV(Memphis-37)__AIY60640.1__F_DSCav1_mut8 (opt1)
  source 1..1922: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19285 - RNA, 1922 nt, synthetic construct
  misc_feature 1..1922: note = mRNA product Design e-2 comprising derived and/or modified sequence from HRSV(Memphis-37)__AIY60640.1__F_DSCav1_mut8 (opt2)
  source 1..1922: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19286 - RNA, 1922 nt, synthetic construct
  misc_feature 1..1922: note = mRNA product Design e-2 comprising derived and/or modified sequence from HRSV(Memphis-37)__AIY60640.1__F_DSCav1_mut8 (opt3)
  source 1..1922: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19287 - RNA, 1922 nt, synthetic construct
  misc_feature 1..1922: note = mRNA product Design e-2 comprising derived and/or modified sequence from HRSV(Memphis-37)__AIY60640.1__F_DSCav1_mut8 (opt4)
  source 1..1922: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19288 - RNA, 1922 nt, synthetic construct
  misc_feature 1..1922: note = mRNA product Design e-2 comprising derived and/or modified sequence from HRSV(Memphis-37)__AIY60640.1__F_DSCav1_mut8 (opt5)
  source 1..1922: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19289 - RNA, 1922 nt, synthetic construct
  misc_feature 1..1922: note = mRNA product Design e-2 comprising derived and/or modified sequence from HRSV(Memphis-37)__AIY60640.1__F_DSCav1_mut8 (opt6)
  source 1..1922: mol_type = other RNA
gggagacccgtgacccggaagttgtacggctacgcgactttccctcccacaaaccctcgcgcccttcctttcctacttgggcccggcagaaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19290 - RNA, 1922 nt, synthetic construct
  misc_feature 1..1922: note = mRNA product Design e-2 comprising derived and/or modified sequence from HRSV(Memphis-37)__AIY60640.1__F_DSCav1_mut8 (opt11)
  source 1..1922: mol_type = other RNA
gggagacccgtgacccggaagttgtacggctacgcgactttccctcccacaaaccctcgcgcccttcctttcctacttgggcccggcagaaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19291 - RNA, 1892 nt, synthetic construct
  misc_feature 1..1892: note = mRNA product Design e-3 comprising derived and/or modified sequence from HRSV(Memphis-37)__AIY60640.1__F_DSCav1_mut8 (opt1)
  source 1..1892: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19292 - RNA, 1892 nt, synthetic construct
  misc_feature 1..1892: note = mRNA product Design e-3 comprising derived and/or modified sequence from HRSV(Memphis-37)__AIY60640.1__F_DSCav1_mut8 (opt1)
  source 1..1892: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19293 - RNA, 1892 nt, synthetic construct
  misc_feature 1..1892: note = mRNA product Design e-3 comprising derived and/or modified sequence from HRSV(Memphis-37)__AIY60640.1__F_DSCav1_mut8 (opt2)
  source 1..1892: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19294 - RNA, 1892 nt, synthetic construct
  misc_feature 1..1892: note = mRNA product Design e-3 comprising derived and/or modified sequence from HRSV(Memphis-37)__AIY60640.1__F_DSCav1_mut8 (opt3)
  source 1..1892: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19295 - RNA, 1892 nt, synthetic construct
  misc_feature 1..1892: note = mRNA product Design e-3 comprising derived and/or modified sequence from HRSV(Memphis-37)__AIY60640.1__F_DSCav1_mut8 (opt4)
  source 1..1892: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19296 - RNA, 1892 nt, synthetic construct
  misc_feature 1..1892: note = mRNA product Design e-3 comprising derived and/or modified sequence from HRSV(Memphis-37)__AIY60640.1__F_DSCav1_mut8 (opt5)
  source 1..1892: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19297 - RNA, 1892 nt, synthetic construct
  misc_feature 1..1892: note = mRNA product Design e-3 comprising derived and/or modified sequence from HRSV(Memphis-37)__AIY60640.1__F_DSCav1_mut8 (opt6)
  source 1..1892: mol_type = other RNA
gggagactttcccattctgtagcagaatttggtgttgcctgtggtcttggtcccgcggagaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19298 - RNA, 1892 nt, synthetic construct
  misc_feature 1..1892: note = mRNA product Design e-3 comprising derived and/or modified sequence from HRSV(Memphis-37)__AIY60640.1__F_DSCav1_mut8 (opt11)
  source 1..1892: mol_type = other RNA
gggagactttcccattctgtagcagaatttggtgttgcctgtggtcttggtcccgcggagaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19299 - RNA, 1946 nt, synthetic construct
  misc_feature 1..1946: note = mRNA product Design e-4 comprising derived and/or modified sequence from HRSV(Memphis-37)__AIY60640.1__F_DSCav1_mut8 (opt1)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19300 - RNA, 1946 nt, synthetic construct
  misc_feature 1..1946: note = mRNA product Design e-4 comprising derived and/or modified sequence from HRSV(Memphis-37)__AIY60640.1__F_DSCav1_mut8 (opt1)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19301 - RNA, 1946 nt, synthetic construct
  misc_feature 1..1946: note = mRNA product Design e-4 comprising derived and/or modified sequence from HRSV(Memphis-37)__AIY60640.1__F_DSCav1_mut8 (opt2)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19302 - RNA, 1946 nt, synthetic construct
  misc_feature 1..1946: note = mRNA product Design e-4 comprising derived and/or modified sequence from HRSV(Memphis-37)__AIY60640.1__F_DSCav1_mut8 (opt3)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19303 - RNA, 1946 nt, synthetic construct
  misc_feature 1..1946: note = mRNA product Design e-4 comprising derived and/or modified sequence from HRSV(Memphis-37)__AIY60640.1__F_DSCav1_mut8 (opt4)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19304 - RNA, 1946 nt, synthetic construct
  misc_feature 1..1946: note = mRNA product Design e-4 comprising derived and/or modified sequence from HRSV(Memphis-37)__AIY60640.1__F_DSCav1_mut8 (opt5)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19305 - RNA, 1946 nt, synthetic construct
  misc_feature 1..1946: note = mRNA product Design e-4 comprising derived and/or modified sequence from HRSV(Memphis-37)__AIY60640.1__F_DSCav1_mut8 (opt6)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19306 - RNA, 1946 nt, synthetic construct
  misc_feature 1..1946: note = mRNA product Design e-4 comprising derived and/or modified sequence from HRSV(Memphis-37)__AIY60640.1__F_DSCav1_mut8 (opt11)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19307 - RNA, 1913 nt, synthetic construct
  misc_feature 1..1913: note = mRNA product Design e-5 comprising derived and/or modified sequence from HRSV(Memphis-37)__AIY60640.1__F_DSCav1_mut8 (opt1)
  source 1..1913: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19308 - RNA, 1913 nt, synthetic construct
  misc_feature 1..1913: note = mRNA product Design e-5 comprising derived and/or modified sequence from HRSV(Memphis-37)__AIY60640.1__F_DSCav1_mut8 (opt1)
  source 1..1913: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19309 - RNA, 1913 nt, synthetic construct
  misc_feature 1..1913: note = mRNA product Design e-5 comprising derived and/or modified sequence from HRSV(Memphis-37)__AIY60640.1__F_DSCav1_mut8 (opt2)
  source 1..1913: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19310 - RNA, 1913 nt, synthetic construct
  misc_feature 1..1913: note = mRNA product Design e-5 comprising derived and/or modified sequence from HRSV(Memphis-37)__AIY60640.1__F_DSCav1_mut8 (opt3)
  source 1..1913: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19311 - RNA, 1913 nt, synthetic construct
  misc_feature 1..1913: note = mRNA product Design e-5 comprising derived and/or modified sequence from HRSV(Memphis-37)__AIY60640.1__F_DSCav1_mut8 (opt4)
  source 1..1913: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19312 - RNA, 1913 nt, synthetic construct
  misc_feature 1..1913: note = mRNA product Design e-5 comprising derived and/or modified sequence from HRSV(Memphis-37)__AIY60640.1__F_DSCav1_mut8 (opt5)
  source 1..1913: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19313 - RNA, 1913 nt, synthetic construct
  misc_feature 1..1913: note = mRNA product Design e-5 comprising derived and/or modified sequence from HRSV(Memphis-37)__AIY60640.1__F_DSCav1_mut8 (opt6)
  source 1..1913: mol_type = other RNA
gggagagcggctcggccattttgtcccagtcagtccggaggctgcggctgcagaagtaccgcctgcggagtaactgcaaagaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19314 - RNA, 1913 nt, synthetic construct
  misc_feature 1..1913: note = mRNA product Design e-5 comprising derived and/or modified sequence from HRSV(Memphis-37)__AIY60640.1__F_DSCav1_mut8 (opt11)
  source 1..1913: mol_type = other RNA
gggagagcggctcggccattttgtcccagtcagtccggaggctgcggctgcagaagtaccgcctgcggagtaactgcaaagaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19315 - RNA, 1980 nt, synthetic construct
  misc_feature 1..1980: note = mRNA product Design e-6 comprising derived and/or modified sequence from HRSV(Memphis-37)__AIY60640.1__F_DSCav1_mut8 (opt1)
  source 1..1980: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19316 - RNA, 1980 nt, synthetic construct
  misc_feature 1..1980: note = mRNA product Design e-6 comprising derived and/or modified sequence from HRSV(Memphis-37)__AIY60640.1__F_DSCav1_mut8 (opt1)
  source 1..1980: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19317 - RNA, 1980 nt, synthetic construct
  misc_feature 1..1980: note = mRNA product Design e-6 comprising derived and/or modified sequence from HRSV(Memphis-37)__AIY60640.1__F_DSCav1_mut8 (opt2)
  source 1..1980: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19318 - RNA, 1980 nt, synthetic construct
  misc_feature 1..1980: note = mRNA product Design e-6 comprising derived and/or modified sequence from HRSV(Memphis-37)__AIY60640.1__F_DSCav1_mut8 (opt3)
  source 1..1980: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19319 - RNA, 1980 nt, synthetic construct
  misc_feature 1..1980: note = mRNA product Design e-6 comprising derived and/or modified sequence from HRSV(Memphis-37)__AIY60640.1__F_DSCav1_mut8 (opt4)
  source 1..1980: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19320 - RNA, 1980 nt, synthetic construct
  misc_feature 1..1980: note = mRNA product Design e-6 comprising derived and/or modified sequence from HRSV(Memphis-37)__AIY60640.1__F_DSCav1_mut8 (opt5)
  source 1..1980: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19321 - RNA, 1980 nt, synthetic construct
  misc_feature 1..1980: note = mRNA product Design e-6 comprising derived and/or modified sequence from HRSV(Memphis-37)__AIY60640.1__F_DSCav1_mut8 (opt6)
  source 1..1980: mol_type = other RNA
gggagagcggctcggccattttgtcccagtcagtccggaggctgcggctgcagaagtaccgcctgcggagtaactgcaaagaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19322 - RNA, 1980 nt, synthetic construct
  misc_feature 1..1980: note = mRNA product Design e-6 comprising derived and/or modified sequence from HRSV(Memphis-37)__AIY60640.1__F_DSCav1_mut8 (opt11)
  source 1..1980: mol_type = other RNA
gggagagcggctcggccattttgtcccagtcagtccggaggctgcggctgcagaagtaccgcctgcggagtaactgcaaagaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19323 - RNA, 2196 nt, synthetic construct
  misc_feature 1..2196: note = mRNA product Design f-1 comprising derived and/or modified sequence from HRSV(Memphis-37)__AIY60640.1__F_DSCav1_mut8 (opt1)
  source 1..2196: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19324 - RNA, 2196 nt, synthetic construct
  misc_feature 1..2196: note = mRNA product Design f-1 comprising derived and/or modified sequence from HRSV(Memphis-37)__AIY60640.1__F_DSCav1_mut8 (opt1)
  source 1..2196: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19325 - RNA, 2196 nt, synthetic construct
  misc_feature 1..2196: note = mRNA product Design f-1 comprising derived and/or modified sequence from HRSV(Memphis-37)__AIY60640.1__F_DSCav1_mut8 (opt2)
  source 1..2196: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19326 - RNA, 2196 nt, synthetic construct
  misc_feature 1..2196: note = mRNA product Design f-1 comprising derived and/or modified sequence from HRSV(Memphis-37)__AIY60640.1__F_DSCav1_mut8 (opt3)
  source 1..2196: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19327 - RNA, 2196 nt, synthetic construct
  misc_feature 1..2196: note = mRNA product Design f-1 comprising derived and/or modified sequence from HRSV(Memphis-37)__AIY60640.1__F_DSCav1_mut8 (opt4)
  source 1..2196: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19328 - RNA, 2196 nt, synthetic construct
  misc_feature 1..2196: note = mRNA product Design f-1 comprising derived and/or modified sequence from HRSV(Memphis-37)__AIY60640.1__F_DSCav1_mut8 (opt5)
  source 1..2196: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19329 - RNA, 2196 nt, synthetic construct
  misc_feature 1..2196: note = mRNA product Design f-1 comprising derived and/or modified sequence from HRSV(Memphis-37)__AIY60640.1__F_DSCav1_mut8 (opt6)
  source 1..2196: mol_type = other RNA
gggagagcggctcggccattttgtcccagtcagtccggaggctgcggctgcagaagtaccgcctgcggagtaactgcaaagaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19330 - RNA, 2196 nt, synthetic construct
  misc_feature 1..2196: note = mRNA product Design f-1 comprising derived and/or modified sequence from HRSV(Memphis-37)__AIY60640.1__F_DSCav1_mut8 (opt11)
  source 1..2196: mol_type = other RNA
gggagagcggctcggccattttgtcccagtcagtccggaggctgcggctgcagaagtaccgcctgcggagtaactgcaaagaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19331 - RNA, 1976 nt, synthetic construct
  misc_feature 1..1976: note = mRNA product Design f-2 comprising derived and/or modified sequence from HRSV(Memphis-37)__AIY60640.1__F_DSCav1_mut8 (opt1)
  source 1..1976: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19332 - RNA, 1976 nt, synthetic construct
  misc_feature 1..1976: note = mRNA product Design f-2 comprising derived and/or modified sequence from HRSV(Memphis-37)__AIY60640.1__F_DSCav1_mut8 (opt1)
  source 1..1976: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19333 - RNA, 1976 nt, synthetic construct
  misc_feature 1..1976: note = mRNA product Design f-2 comprising derived and/or modified sequence from HRSV(Memphis-37)__AIY60640.1__F_DSCav1_mut8 (opt2)
  source 1..1976: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19334 - RNA, 1976 nt, synthetic construct
  misc_feature 1..1976: note = mRNA product Design f-2 comprising derived and/or modified sequence from HRSV(Memphis-37)__AIY60640.1__F_DSCav1_mut8 (opt3)
  source 1..1976: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19335 - RNA, 1976 nt, synthetic construct
  misc_feature 1..1976: note = mRNA product Design f-2 comprising derived and/or modified sequence from HRSV(Memphis-37)__AIY60640.1__F_DSCav1_mut8 (opt4)
  source 1..1976: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19336 - RNA, 1976 nt, synthetic construct
  misc_feature 1..1976: note = mRNA product Design f-2 comprising derived and/or modified sequence from HRSV(Memphis-37)__AIY60640.1__F_DSCav1_mut8 (opt5)
  source 1..1976: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19337 - RNA, 1976 nt, synthetic construct
  misc_feature 1..1976: note = mRNA product Design f-2 comprising derived and/or modified sequence from HRSV(Memphis-37)__AIY60640.1__F_DSCav1_mut8 (opt6)
  source 1..1976: mol_type = other RNA
gggagagcggctcggccattttgtcccagtcagtccggaggctgcggctgcagaagtaccgcctgcggagtaactgcaaagaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19338 - RNA, 1976 nt, synthetic construct
  misc_feature 1..1976: note = mRNA product Design f-2 comprising derived and/or modified sequence from HRSV(Memphis-37)__AIY60640.1__F_DSCav1_mut8 (opt11)
  source 1..1976: mol_type = other RNA
gggagagcggctcggccattttgtcccagtcagtccggaggctgcggctgcagaagtaccgcctgcggagtaactgcaaagaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19339 - RNA, 1967 nt, synthetic construct
  misc_feature 1..1967: note = mRNA product Design f-3 comprising derived and/or modified sequence from HRSV(Memphis-37)__AIY60640.1__F_DSCav1_mut8 (opt1)
  source 1..1967: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19340 - RNA, 1967 nt, synthetic construct
  misc_feature 1..1967: note = mRNA product Design f-3 comprising derived and/or modified sequence from HRSV(Memphis-37)__AIY60640.1__F_DSCav1_mut8 (opt1)
  source 1..1967: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19341 - RNA, 1967 nt, synthetic construct
  misc_feature 1..1967: note = mRNA product Design f-3 comprising derived and/or modified sequence from HRSV(Memphis-37)__AIY60640.1__F_DSCav1_mut8 (opt2)
  source 1..1967: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19342 - RNA, 1967 nt, synthetic construct
  misc_feature 1..1967: note = mRNA product Design f-3 comprising derived and/or modified sequence from HRSV(Memphis-37)__AIY60640.1__F_DSCav1_mut8 (opt3)
  source 1..1967: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19343 - RNA, 1967 nt, synthetic construct
  misc_feature 1..1967: note = mRNA product Design f-3 comprising derived and/or modified sequence from HRSV(Memphis-37)__AIY60640.1__F_DSCav1_mut8 (opt4)
  source 1..1967: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19344 - RNA, 1967 nt, synthetic construct
  misc_feature 1..1967: note = mRNA product Design f-3 comprising derived and/or modified sequence from HRSV(Memphis-37)__AIY60640.1__F_DSCav1_mut8 (opt5)
  source 1..1967: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19345 - RNA, 1967 nt, synthetic construct
  misc_feature 1..1967: note = mRNA product Design f-3 comprising derived and/or modified sequence from HRSV(Memphis-37)__AIY60640.1__F_DSCav1_mut8 (opt6)
  source 1..1967: mol_type = other RNA
gggagagtcccgcagtcggcgtccagcggctctgcttgttcgtgtgtgtgtcgttgcaggccttattcaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19346 - RNA, 1967 nt, synthetic construct
  misc_feature 1..1967: note = mRNA product Design f-3 comprising derived and/or modified sequence from HRSV(Memphis-37)__AIY60640.1__F_DSCav1_mut8 (opt11)
  source 1..1967: mol_type = other RNA
gggagagtcccgcagtcggcgtccagcggctctgcttgttcgtgtgtgtgtcgttgcaggccttattcaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19347 - RNA, 2183 nt, synthetic construct
  misc_feature 1..2183: note = mRNA product Design f-4 comprising derived and/or modified sequence from HRSV(Memphis-37)__AIY60640.1__F_DSCav1_mut8 (opt1)
  source 1..2183: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19348 - RNA, 2183 nt, synthetic construct
  misc_feature 1..2183: note = mRNA product Design f-4 comprising derived and/or modified sequence from HRSV(Memphis-37)__AIY60640.1__F_DSCav1_mut8 (opt1)
  source 1..2183: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19349 - RNA, 2183 nt, synthetic construct
  misc_feature 1..2183: note = mRNA product Design f-4 comprising derived and/or modified sequence from HRSV(Memphis-37)__AIY60640.1__F_DSCav1_mut8 (opt2)
  source 1..2183: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19350 - RNA, 2183 nt, synthetic construct
  misc_feature 1..2183: note = mRNA product Design f-4 comprising derived and/or modified sequence from HRSV(Memphis-37)__AIY60640.1__F_DSCav1_mut8 (opt3)
  source 1..2183: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19351 - RNA, 2183 nt, synthetic construct
  misc_feature 1..2183: note = mRNA product Design f-4 comprising derived and/or modified sequence from HRSV(Memphis-37)__AIY60640.1__F_DSCav1_mut8 (opt4)
  source 1..2183: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19352 - RNA, 2183 nt, synthetic construct
  misc_feature 1..2183: note = mRNA product Design f-4 comprising derived and/or modified sequence from HRSV(Memphis-37)__AIY60640.1__F_DSCav1_mut8 (opt5)
  source 1..2183: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19353 - RNA, 2183 nt, synthetic construct
  misc_feature 1..2183: note = mRNA product Design f-4 comprising derived and/or modified sequence from HRSV(Memphis-37)__AIY60640.1__F_DSCav1_mut8 (opt6)
  source 1..2183: mol_type = other RNA
gggagagtcccgcagtcggcgtccagcggctctgcttgttcgtgtgtgtgtcgttgcaggccttattcaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19354 - RNA, 2183 nt, synthetic construct
  misc_feature 1..2183: note = mRNA product Design f-4 comprising derived and/or modified sequence from HRSV(Memphis-37)__AIY60640.1__F_DSCav1_mut8 (opt11)
  source 1..2183: mol_type = other RNA
gggagagtcccgcagtcggcgtccagcggctctgcttgttcgtgtgtgtgtcgttgcaggccttattcaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19355 - RNA, 1959 nt, synthetic construct
  misc_feature 1..1959: note = mRNA product Design f-5 comprising derived and/or modified sequence from HRSV(Memphis-37)__AIY60640.1__F_DSCav1_mut8 (opt1)
  source 1..1959: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19356 - RNA, 1959 nt, synthetic construct
  misc_feature 1..1959: note = mRNA product Design f-5 comprising derived and/or modified sequence from HRSV(Memphis-37)__AIY60640.1__F_DSCav1_mut8 (opt1)
  source 1..1959: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19357 - RNA, 1959 nt, synthetic construct
  misc_feature 1..1959: note = mRNA product Design f-5 comprising derived and/or modified sequence from HRSV(Memphis-37)__AIY60640.1__F_DSCav1_mut8 (opt2)
  source 1..1959: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19358 - RNA, 1959 nt, synthetic construct
  misc_feature 1..1959: note = mRNA product Design f-5 comprising derived and/or modified sequence from HRSV(Memphis-37)__AIY60640.1__F_DSCav1_mut8 (opt3)
  source 1..1959: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19359 - RNA, 1959 nt, synthetic construct
  misc_feature 1..1959: note = mRNA product Design f-5 comprising derived and/or modified sequence from HRSV(Memphis-37)__AIY60640.1__F_DSCav1_mut8 (opt4)
  source 1..1959: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19360 - RNA, 1959 nt, synthetic construct
  misc_feature 1..1959: note = mRNA product Design f-5 comprising derived and/or modified sequence from HRSV(Memphis-37)__AIY60640.1__F_DSCav1_mut8 (opt5)
  source 1..1959: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19361 - RNA, 1959 nt, synthetic construct
  misc_feature 1..1959: note = mRNA product Design f-5 comprising derived and/or modified sequence from HRSV(Memphis-37)__AIY60640.1__F_DSCav1_mut8 (opt6)
  source 1..1959: mol_type = other RNA
gggagactttcccattctgtagcagaatttggtgttgcctgtggtcttggtcccgcggagaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19362 - RNA, 1959 nt, synthetic construct
  misc_feature 1..1959: note = mRNA product Design f-5 comprising derived and/or modified sequence from HRSV(Memphis-37)__AIY60640.1__F_DSCav1_mut8 (opt11)
  source 1..1959: mol_type = other RNA
gggagactttcccattctgtagcagaatttggtgttgcctgtggtcttggtcccgcggagaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19363 - RNA, 1955 nt, synthetic construct
  misc_feature 1..1955: note = mRNA product Design g-1 comprising derived and/or modified sequence from HRSV(Memphis-37)__AIY60640.1__F_DSCav1_mut8 (opt1)
  source 1..1955: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19364 - RNA, 1955 nt, synthetic construct
  misc_feature 1..1955: note = mRNA product Design g-1 comprising derived and/or modified sequence from HRSV(Memphis-37)__AIY60640.1__F_DSCav1_mut8 (opt1)
  source 1..1955: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19365 - RNA, 1955 nt, synthetic construct
  misc_feature 1..1955: note = mRNA product Design g-1 comprising derived and/or modified sequence from HRSV(Memphis-37)__AIY60640.1__F_DSCav1_mut8 (opt2)
  source 1..1955: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19366 - RNA, 1955 nt, synthetic construct
  misc_feature 1..1955: note = mRNA product Design g-1 comprising derived and/or modified sequence from HRSV(Memphis-37)__AIY60640.1__F_DSCav1_mut8 (opt3)
  source 1..1955: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19367 - RNA, 1955 nt, synthetic construct
  misc_feature 1..1955: note = mRNA product Design g-1 comprising derived and/or modified sequence from HRSV(Memphis-37)__AIY60640.1__F_DSCav1_mut8 (opt4)
  source 1..1955: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19368 - RNA, 1955 nt, synthetic construct
  misc_feature 1..1955: note = mRNA product Design g-1 comprising derived and/or modified sequence from HRSV(Memphis-37)__AIY60640.1__F_DSCav1_mut8 (opt5)
  source 1..1955: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19369 - RNA, 1955 nt, synthetic construct
  misc_feature 1..1955: note = mRNA product Design g-1 comprising derived and/or modified sequence from HRSV(Memphis-37)__AIY60640.1__F_DSCav1_mut8 (opt6)
  source 1..1955: mol_type = other RNA
gggagactttcccattctgtagcagaatttggtgttgcctgtggtcttggtcccgcggagaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19370 - RNA, 1955 nt, synthetic construct
  misc_feature 1..1955: note = mRNA product Design g-1 comprising derived and/or modified sequence from HRSV(Memphis-37)__AIY60640.1__F_DSCav1_mut8 (opt11)
  source 1..1955: mol_type = other RNA
gggagactttcccattctgtagcagaatttggtgttgcctgtggtcttggtcccgcggagaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19371 - RNA, 1970 nt, synthetic construct
  misc_feature 1..1970: note = mRNA product Design g-2 comprising derived and/or modified sequence from HRSV(Memphis-37)__AIY60640.1__F_DSCav1_mut8 (opt1)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19372 - RNA, 1970 nt, synthetic construct
  misc_feature 1..1970: note = mRNA product Design g-2 comprising derived and/or modified sequence from HRSV(Memphis-37)__AIY60640.1__F_DSCav1_mut8 (opt1)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19373 - RNA, 1970 nt, synthetic construct
  misc_feature 1..1970: note = mRNA product Design g-2 comprising derived and/or modified sequence from HRSV(Memphis-37)__AIY60640.1__F_DSCav1_mut8 (opt2)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19374 - RNA, 1970 nt, synthetic construct
  misc_feature 1..1970: note = mRNA product Design g-2 comprising derived and/or modified sequence from HRSV(Memphis-37)__AIY60640.1__F_DSCav1_mut8 (opt3)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19375 - RNA, 1970 nt, synthetic construct
  misc_feature 1..1970: note = mRNA product Design g-2 comprising derived and/or modified sequence from HRSV(Memphis-37)__AIY60640.1__F_DSCav1_mut8 (opt4)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19376 - RNA, 1970 nt, synthetic construct
  misc_feature 1..1970: note = mRNA product Design g-2 comprising derived and/or modified sequence from HRSV(Memphis-37)__AIY60640.1__F_DSCav1_mut8 (opt5)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19377 - RNA, 1970 nt, synthetic construct
  misc_feature 1..1970: note = mRNA product Design g-2 comprising derived and/or modified sequence from HRSV(Memphis-37)__AIY60640.1__F_DSCav1_mut8 (opt6)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19378 - RNA, 1970 nt, synthetic construct
  misc_feature 1..1970: note = mRNA product Design g-2 comprising derived and/or modified sequence from HRSV(Memphis-37)__AIY60640.1__F_DSCav1_mut8 (opt11)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19379 - RNA, 2202 nt, synthetic construct
  misc_feature 1..2202: note = mRNA product Design g-3 comprising derived and/or modified sequence from HRSV(Memphis-37)__AIY60640.1__F_DSCav1_mut8 (opt1)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19380 - RNA, 2202 nt, synthetic construct
  misc_feature 1..2202: note = mRNA product Design g-3 comprising derived and/or modified sequence from HRSV(Memphis-37)__AIY60640.1__F_DSCav1_mut8 (opt1)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19381 - RNA, 2202 nt, synthetic construct
  misc_feature 1..2202: note = mRNA product Design g-3 comprising derived and/or modified sequence from HRSV(Memphis-37)__AIY60640.1__F_DSCav1_mut8 (opt2)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19382 - RNA, 2202 nt, synthetic construct
  misc_feature 1..2202: note = mRNA product Design g-3 comprising derived and/or modified sequence from HRSV(Memphis-37)__AIY60640.1__F_DSCav1_mut8 (opt3)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19383 - RNA, 2202 nt, synthetic construct
  misc_feature 1..2202: note = mRNA product Design g-3 comprising derived and/or modified sequence from HRSV(Memphis-37)__AIY60640.1__F_DSCav1_mut8 (opt4)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19384 - RNA, 2202 nt, synthetic construct
  misc_feature 1..2202: note = mRNA product Design g-3 comprising derived and/or modified sequence from HRSV(Memphis-37)__AIY60640.1__F_DSCav1_mut8 (opt5)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19385 - RNA, 2202 nt, synthetic construct
  misc_feature 1..2202: note = mRNA product Design g-3 comprising derived and/or modified sequence from HRSV(Memphis-37)__AIY60640.1__F_DSCav1_mut8 (opt6)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19386 - RNA, 2202 nt, synthetic construct
  misc_feature 1..2202: note = mRNA product Design g-3 comprising derived and/or modified sequence from HRSV(Memphis-37)__AIY60640.1__F_DSCav1_mut8 (opt11)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19387 - RNA, 1997 nt, synthetic construct
  misc_feature 1..1997: note = mRNA product Design g-4 comprising derived and/or modified sequence from HRSV(Memphis-37)__AIY60640.1__F_DSCav1_mut8 (opt1)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19388 - RNA, 1997 nt, synthetic construct
  misc_feature 1..1997: note = mRNA product Design g-4 comprising derived and/or modified sequence from HRSV(Memphis-37)__AIY60640.1__F_DSCav1_mut8 (opt1)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19389 - RNA, 1997 nt, synthetic construct
  misc_feature 1..1997: note = mRNA product Design g-4 comprising derived and/or modified sequence from HRSV(Memphis-37)__AIY60640.1__F_DSCav1_mut8 (opt2)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19390 - RNA, 1997 nt, synthetic construct
  misc_feature 1..1997: note = mRNA product Design g-4 comprising derived and/or modified sequence from HRSV(Memphis-37)__AIY60640.1__F_DSCav1_mut8 (opt3)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19391 - RNA, 1997 nt, synthetic construct
  misc_feature 1..1997: note = mRNA product Design g-4 comprising derived and/or modified sequence from HRSV(Memphis-37)__AIY60640.1__F_DSCav1_mut8 (opt4)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19392 - RNA, 1997 nt, synthetic construct
  misc_feature 1..1997: note = mRNA product Design g-4 comprising derived and/or modified sequence from HRSV(Memphis-37)__AIY60640.1__F_DSCav1_mut8 (opt5)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19393 - RNA, 1997 nt, synthetic construct
  misc_feature 1..1997: note = mRNA product Design g-4 comprising derived and/or modified sequence from HRSV(Memphis-37)__AIY60640.1__F_DSCav1_mut8 (opt6)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19394 - RNA, 1997 nt, synthetic construct
  misc_feature 1..1997: note = mRNA product Design g-4 comprising derived and/or modified sequence from HRSV(Memphis-37)__AIY60640.1__F_DSCav1_mut8 (opt11)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19395 - RNA, 1973 nt, synthetic construct
  misc_feature 1..1973: note = mRNA product Design g-5 comprising derived and/or modified sequence from HRSV(Memphis-37)__AIY60640.1__F_DSCav1_mut8 (opt1)
  source 1..1973: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19396 - RNA, 1973 nt, synthetic construct
  misc_feature 1..1973: note = mRNA product Design g-5 comprising derived and/or modified sequence from HRSV(Memphis-37)__AIY60640.1__F_DSCav1_mut8 (opt1)
  source 1..1973: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19397 - RNA, 1973 nt, synthetic construct
  misc_feature 1..1973: note = mRNA product Design g-5 comprising derived and/or modified sequence from HRSV(Memphis-37)__AIY60640.1__F_DSCav1_mut8 (opt2)
  source 1..1973: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19398 - RNA, 1973 nt, synthetic construct
  misc_feature 1..1973: note = mRNA product Design g-5 comprising derived and/or modified sequence from HRSV(Memphis-37)__AIY60640.1__F_DSCav1_mut8 (opt3)
  source 1..1973: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19399 - RNA, 1973 nt, synthetic construct
  misc_feature 1..1973: note = mRNA product Design g-5 comprising derived and/or modified sequence from HRSV(Memphis-37)__AIY60640.1__F_DSCav1_mut8 (opt4)
  source 1..1973: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19400 - RNA, 1973 nt, synthetic construct
  misc_feature 1..1973: note = mRNA product Design g-5 comprising derived and/or modified sequence from HRSV(Memphis-37)__AIY60640.1__F_DSCav1_mut8 (opt5)
  source 1..1973: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19401 - RNA, 1973 nt, synthetic construct
  misc_feature 1..1973: note = mRNA product Design g-5 comprising derived and/or modified sequence from HRSV(Memphis-37)__AIY60640.1__F_DSCav1_mut8 (opt6)
  source 1..1973: mol_type = other RNA
gggagacccgtgacccggaagttgtacggctacgcgactttccctcccacaaaccctcgcgcccttcctttcctacttgggcccggcagaaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19402 - RNA, 1973 nt, synthetic construct
  misc_feature 1..1973: note = mRNA product Design g-5 comprising derived and/or modified sequence from HRSV(Memphis-37)__AIY60640.1__F_DSCav1_mut8 (opt11)
  source 1..1973: mol_type = other RNA
gggagacccgtgacccggaagttgtacggctacgcgactttccctcccacaaaccctcgcgcccttcctttcctacttgggcccggcagaaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19403 - RNA, 1989 nt, synthetic construct
  misc_feature 1..1989: note = mRNA product Design h-1 comprising derived and/or modified sequence from HRSV(Memphis-37)__AIY60640.1__F_DSCav1_mut8 (opt1)
  source 1..1989: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19404 - RNA, 1989 nt, synthetic construct
  misc_feature 1..1989: note = mRNA product Design h-1 comprising derived and/or modified sequence from HRSV(Memphis-37)__AIY60640.1__F_DSCav1_mut8 (opt1)
  source 1..1989: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19405 - RNA, 1989 nt, synthetic construct
  misc_feature 1..1989: note = mRNA product Design h-1 comprising derived and/or modified sequence from HRSV(Memphis-37)__AIY60640.1__F_DSCav1_mut8 (opt2)
  source 1..1989: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19406 - RNA, 1989 nt, synthetic construct
  misc_feature 1..1989: note = mRNA product Design h-1 comprising derived and/or modified sequence from HRSV(Memphis-37)__AIY60640.1__F_DSCav1_mut8 (opt3)
  source 1..1989: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19407 - RNA, 1989 nt, synthetic construct
  misc_feature 1..1989: note = mRNA product Design h-1 comprising derived and/or modified sequence from HRSV(Memphis-37)__AIY60640.1__F_DSCav1_mut8 (opt4)
  source 1..1989: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19408 - RNA, 1989 nt, synthetic construct
  misc_feature 1..1989: note = mRNA product Design h-1 comprising derived and/or modified sequence from HRSV(Memphis-37)__AIY60640.1__F_DSCav1_mut8 (opt5)
  source 1..1989: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19409 - RNA, 1989 nt, synthetic construct
  misc_feature 1..1989: note = mRNA product Design h-1 comprising derived and/or modified sequence from HRSV(Memphis-37)__AIY60640.1__F_DSCav1_mut8 (opt6)
  source 1..1989: mol_type = other RNA
gggagacccgtgacccggaagttgtacggctacgcgactttccctcccacaaaccctcgcgcccttcctttcctacttgggcccggcagaaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19410 - RNA, 1989 nt, synthetic construct
  misc_feature 1..1989: note = mRNA product Design h-1 comprising derived and/or modified sequence from HRSV(Memphis-37)__AIY60640.1__F_DSCav1_mut8 (opt11)
  source 1..1989: mol_type = other RNA
gggagacccgtgacccggaagttgtacggctacgcgactttccctcccacaaaccctcgcgcccttcctttcctacttgggcccggcagaaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19411 - RNA, 2205 nt, synthetic construct
  misc_feature 1..2205: note = mRNA product Design h-2 comprising derived and/or modified sequence from HRSV(Memphis-37)__AIY60640.1__F_DSCav1_mut8 (opt1)
  source 1..2205: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19412 - RNA, 2205 nt, synthetic construct
  misc_feature 1..2205: note = mRNA product Design h-2 comprising derived and/or modified sequence from HRSV(Memphis-37)__AIY60640.1__F_DSCav1_mut8 (opt1)
  source 1..2205: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19413 - RNA, 2205 nt, synthetic construct
  misc_feature 1..2205: note = mRNA product Design h-2 comprising derived and/or modified sequence from HRSV(Memphis-37)__AIY60640.1__F_DSCav1_mut8 (opt2)
  source 1..2205: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19414 - RNA, 2205 nt, synthetic construct
  misc_feature 1..2205: note = mRNA product Design h-2 comprising derived and/or modified sequence from HRSV(Memphis-37)__AIY60640.1__F_DSCav1_mut8 (opt3)
  source 1..2205: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19415 - RNA, 2205 nt, synthetic construct
  misc_feature 1..2205: note = mRNA product Design h-2 comprising derived and/or modified sequence from HRSV(Memphis-37)__AIY60640.1__F_DSCav1_mut8 (opt4)
  source 1..2205: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19416 - RNA, 2205 nt, synthetic construct
  misc_feature 1..2205: note = mRNA product Design h-2 comprising derived and/or modified sequence from HRSV(Memphis-37)__AIY60640.1__F_DSCav1_mut8 (opt5)
  source 1..2205: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19417 - RNA, 2205 nt, synthetic construct
  misc_feature 1..2205: note = mRNA product Design h-2 comprising derived and/or modified sequence from HRSV(Memphis-37)__AIY60640.1__F_DSCav1_mut8 (opt6)
  source 1..2205: mol_type = other RNA
gggagacccgtgacccggaagttgtacggctacgcgactttccctcccacaaaccctcgcgcccttcctttcctacttgggcccggcagaaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19418 - RNA, 2205 nt, synthetic construct
  misc_feature 1..2205: note = mRNA product Design h-2 comprising derived and/or modified sequence from HRSV(Memphis-37)__AIY60640.1__F_DSCav1_mut8 (opt11)
  source 1..2205: mol_type = other RNA
gggagacccgtgacccggaagttgtacggctacgcgactttccctcccacaaaccctcgcgcccttcctttcctacttgggcccggcagaaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19419 - RNA, 1985 nt, synthetic construct
  misc_feature 1..1985: note = mRNA product Design h-3 comprising derived and/or modified sequence from HRSV(Memphis-37)__AIY60640.1__F_DSCav1_mut8 (opt1)
  source 1..1985: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19420 - RNA, 1985 nt, synthetic construct
  misc_feature 1..1985: note = mRNA product Design h-3 comprising derived and/or modified sequence from HRSV(Memphis-37)__AIY60640.1__F_DSCav1_mut8 (opt1)
  source 1..1985: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19421 - RNA, 1985 nt, synthetic construct
  misc_feature 1..1985: note = mRNA product Design h-3 comprising derived and/or modified sequence from HRSV(Memphis-37)__AIY60640.1__F_DSCav1_mut8 (opt2)
  source 1..1985: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19422 - RNA, 1985 nt, synthetic construct
  misc_feature 1..1985: note = mRNA product Design h-3 comprising derived and/or modified sequence from HRSV(Memphis-37)__AIY60640.1__F_DSCav1_mut8 (opt3)
  source 1..1985: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19423 - RNA, 1985 nt, synthetic construct
  misc_feature 1..1985: note = mRNA product Design h-3 comprising derived and/or modified sequence from HRSV(Memphis-37)__AIY60640.1__F_DSCav1_mut8 (opt4)
  source 1..1985: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19424 - RNA, 1985 nt, synthetic construct
  misc_feature 1..1985: note = mRNA product Design h-3 comprising derived and/or modified sequence from HRSV(Memphis-37)__AIY60640.1__F_DSCav1_mut8 (opt5)
  source 1..1985: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19425 - RNA, 1985 nt, synthetic construct
  misc_feature 1..1985: note = mRNA product Design h-3 comprising derived and/or modified sequence from HRSV(Memphis-37)__AIY60640.1__F_DSCav1_mut8 (opt6)
  source 1..1985: mol_type = other RNA
gggagacccgtgacccggaagttgtacggctacgcgactttccctcccacaaaccctcgcgcccttcctttcctacttgggcccggcagaaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19426 - RNA, 1985 nt, synthetic construct
  misc_feature 1..1985: note = mRNA product Design h-3 comprising derived and/or modified sequence from HRSV(Memphis-37)__AIY60640.1__F_DSCav1_mut8 (opt11)
  source 1..1985: mol_type = other RNA
gggagacccgtgacccggaagttgtacggctacgcgactttccctcccacaaaccctcgcgcccttcctttcctacttgggcccggcagaaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19427 - RNA, 2048 nt, synthetic construct
  misc_feature 1..2048: note = mRNA product Design h-4 comprising derived and/or modified sequence from HRSV(Memphis-37)__AIY60640.1__F_DSCav1_mut8 (opt1)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19428 - RNA, 2048 nt, synthetic construct
  misc_feature 1..2048: note = mRNA product Design h-4 comprising derived and/or modified sequence from HRSV(Memphis-37)__AIY60640.1__F_DSCav1_mut8 (opt1)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19429 - RNA, 2048 nt, synthetic construct
  misc_feature 1..2048: note = mRNA product Design h-4 comprising derived and/or modified sequence from HRSV(Memphis-37)__AIY60640.1__F_DSCav1_mut8 (opt2)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19430 - RNA, 2048 nt, synthetic construct
  misc_feature 1..2048: note = mRNA product Design h-4 comprising derived and/or modified sequence from HRSV(Memphis-37)__AIY60640.1__F_DSCav1_mut8 (opt3)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19431 - RNA, 2048 nt, synthetic construct
  misc_feature 1..2048: note = mRNA product Design h-4 comprising derived and/or modified sequence from HRSV(Memphis-37)__AIY60640.1__F_DSCav1_mut8 (opt4)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19432 - RNA, 2048 nt, synthetic construct
  misc_feature 1..2048: note = mRNA product Design h-4 comprising derived and/or modified sequence from HRSV(Memphis-37)__AIY60640.1__F_DSCav1_mut8 (opt5)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19433 - RNA, 2048 nt, synthetic construct
  misc_feature 1..2048: note = mRNA product Design h-4 comprising derived and/or modified sequence from HRSV(Memphis-37)__AIY60640.1__F_DSCav1_mut8 (opt6)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19434 - RNA, 2048 nt, synthetic construct
  misc_feature 1..2048: note = mRNA product Design h-4 comprising derived and/or modified sequence from HRSV(Memphis-37)__AIY60640.1__F_DSCav1_mut8 (opt11)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19435 - RNA, 2064 nt, synthetic construct
  misc_feature 1..2064: note = mRNA product Design h-5 comprising derived and/or modified sequence from HRSV(Memphis-37)__AIY60640.1__F_DSCav1_mut8 (opt1)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19436 - RNA, 2064 nt, synthetic construct
  misc_feature 1..2064: note = mRNA product Design h-5 comprising derived and/or modified sequence from HRSV(Memphis-37)__AIY60640.1__F_DSCav1_mut8 (opt1)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19437 - RNA, 2064 nt, synthetic construct
  misc_feature 1..2064: note = mRNA product Design h-5 comprising derived and/or modified sequence from HRSV(Memphis-37)__AIY60640.1__F_DSCav1_mut8 (opt2)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19438 - RNA, 2064 nt, synthetic construct
  misc_feature 1..2064: note = mRNA product Design h-5 comprising derived and/or modified sequence from HRSV(Memphis-37)__AIY60640.1__F_DSCav1_mut8 (opt3)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19439 - RNA, 2064 nt, synthetic construct
  misc_feature 1..2064: note = mRNA product Design h-5 comprising derived and/or modified sequence from HRSV(Memphis-37)__AIY60640.1__F_DSCav1_mut8 (opt4)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19440 - RNA, 2064 nt, synthetic construct
  misc_feature 1..2064: note = mRNA product Design h-5 comprising derived and/or modified sequence from HRSV(Memphis-37)__AIY60640.1__F_DSCav1_mut8 (opt5)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19441 - RNA, 2064 nt, synthetic construct
  misc_feature 1..2064: note = mRNA product Design h-5 comprising derived and/or modified sequence from HRSV(Memphis-37)__AIY60640.1__F_DSCav1_mut8 (opt6)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19442 - RNA, 2064 nt, synthetic construct
  misc_feature 1..2064: note = mRNA product Design h-5 comprising derived and/or modified sequence from HRSV(Memphis-37)__AIY60640.1__F_DSCav1_mut8 (opt11)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19443 - RNA, 1997 nt, synthetic construct
  misc_feature 1..1997: note = mRNA product Design i-1 comprising derived and/or modified sequence from HRSV(Memphis-37)__AIY60640.1__F_DSCav1_mut8 (opt1)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19444 - RNA, 1997 nt, synthetic construct
  misc_feature 1..1997: note = mRNA product Design i-1 comprising derived and/or modified sequence from HRSV(Memphis-37)__AIY60640.1__F_DSCav1_mut8 (opt1)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19445 - RNA, 1997 nt, synthetic construct
  misc_feature 1..1997: note = mRNA product Design i-1 comprising derived and/or modified sequence from HRSV(Memphis-37)__AIY60640.1__F_DSCav1_mut8 (opt2)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19446 - RNA, 1997 nt, synthetic construct
  misc_feature 1..1997: note = mRNA product Design i-1 comprising derived and/or modified sequence from HRSV(Memphis-37)__AIY60640.1__F_DSCav1_mut8 (opt3)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19447 - RNA, 1997 nt, synthetic construct
  misc_feature 1..1997: note = mRNA product Design i-1 comprising derived and/or modified sequence from HRSV(Memphis-37)__AIY60640.1__F_DSCav1_mut8 (opt4)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19448 - RNA, 1997 nt, synthetic construct
  misc_feature 1..1997: note = mRNA product Design i-1 comprising derived and/or modified sequence from HRSV(Memphis-37)__AIY60640.1__F_DSCav1_mut8 (opt5)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19449 - RNA, 1997 nt, synthetic construct
  misc_feature 1..1997: note = mRNA product Design i-1 comprising derived and/or modified sequence from HRSV(Memphis-37)__AIY60640.1__F_DSCav1_mut8 (opt6)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19450 - RNA, 1997 nt, synthetic construct
  misc_feature 1..1997: note = mRNA product Design i-1 comprising derived and/or modified sequence from HRSV(Memphis-37)__AIY60640.1__F_DSCav1_mut8 (opt11)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19451 - RNA, 1997 nt, synthetic construct
  misc_feature 1..1997: note = mRNA product Design i-2 comprising derived and/or modified sequence from HRSV(Memphis-37)__AIY60640.1__F_DSCav1_mut8 (opt1)
  source 1..1997: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19452 - RNA, 1997 nt, synthetic construct
  misc_feature 1..1997: note = mRNA product Design i-2 comprising derived and/or modified sequence from HRSV(Memphis-37)__AIY60640.1__F_DSCav1_mut8 (opt1)
  source 1..1997: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19453 - RNA, 1997 nt, synthetic construct
  misc_feature 1..1997: note = mRNA product Design i-2 comprising derived and/or modified sequence from HRSV(Memphis-37)__AIY60640.1__F_DSCav1_mut8 (opt2)
  source 1..1997: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19454 - RNA, 1997 nt, synthetic construct
  misc_feature 1..1997: note = mRNA product Design i-2 comprising derived and/or modified sequence from HRSV(Memphis-37)__AIY60640.1__F_DSCav1_mut8 (opt3)
  source 1..1997: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19455 - RNA, 1997 nt, synthetic construct
  misc_feature 1..1997: note = mRNA product Design i-2 comprising derived and/or modified sequence from HRSV(Memphis-37)__AIY60640.1__F_DSCav1_mut8 (opt4)
  source 1..1997: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19456 - RNA, 1997 nt, synthetic construct
  misc_feature 1..1997: note = mRNA product Design i-2 comprising derived and/or modified sequence from HRSV(Memphis-37)__AIY60640.1__F_DSCav1_mut8 (opt5)
  source 1..1997: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19457 - RNA, 1997 nt, synthetic construct
  misc_feature 1..1997: note = mRNA product Design i-2 comprising derived and/or modified sequence from HRSV(Memphis-37)__AIY60640.1__F_DSCav1_mut8 (opt6)
  source 1..1997: mol_type = other RNA
gggagaggcgctgcctacggaggtggcagccatctccttctcggcatcaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19458 - RNA, 1997 nt, synthetic construct
  misc_feature 1..1997: note = mRNA product Design i-2 comprising derived and/or modified sequence from HRSV(Memphis-37)__AIY60640.1__F_DSCav1_mut8 (opt11)
  source 1..1997: mol_type = other RNA
gggagaggcgctgcctacggaggtggcagccatctccttctcggcatcaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19459 - RNA, 1993 nt, synthetic construct
  misc_feature 1..1993: note = mRNA product Design i-2 comprising derived and/or modified sequence from HRSV(Memphis-37)__AIY60640.1__F_DSCav1_mut8 (opt1)
  source 1..1993: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19460 - RNA, 1993 nt, synthetic construct
  misc_feature 1..1993: note = mRNA product Design i-2 comprising derived and/or modified sequence from HRSV(Memphis-37)__AIY60640.1__F_DSCav1_mut8 (opt1)
  source 1..1993: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19461 - RNA, 1993 nt, synthetic construct
  misc_feature 1..1993: note = mRNA product Design i-2 comprising derived and/or modified sequence from HRSV(Memphis-37)__AIY60640.1__F_DSCav1_mut8 (opt2)
  source 1..1993: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19462 - RNA, 1993 nt, synthetic construct
  misc_feature 1..1993: note = mRNA product Design i-2 comprising derived and/or modified sequence from HRSV(Memphis-37)__AIY60640.1__F_DSCav1_mut8 (opt3)
  source 1..1993: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19463 - RNA, 1993 nt, synthetic construct
  misc_feature 1..1993: note = mRNA product Design i-2 comprising derived and/or modified sequence from HRSV(Memphis-37)__AIY60640.1__F_DSCav1_mut8 (opt4)
  source 1..1993: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19464 - RNA, 1993 nt, synthetic construct
  misc_feature 1..1993: note = mRNA product Design i-2 comprising derived and/or modified sequence from HRSV(Memphis-37)__AIY60640.1__F_DSCav1_mut8 (opt5)
  source 1..1993: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19465 - RNA, 1993 nt, synthetic construct
  misc_feature 1..1993: note = mRNA product Design i-2 comprising derived and/or modified sequence from HRSV(Memphis-37)__AIY60640.1__F_DSCav1_mut8 (opt6)
  source 1..1993: mol_type = other RNA
ggggcgctgcctacggaggtggcagccatctccttctcggcatcaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19466 - RNA, 1993 nt, synthetic construct
  misc_feature 1..1993: note = mRNA product Design i-2 comprising derived and/or modified sequence from HRSV(Memphis-37)__AIY60640.1__F_DSCav1_mut8 (opt11)
  source 1..1993: mol_type = other RNA
ggggcgctgcctacggaggtggcagccatctccttctcggcatcaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19467 - RNA, 1828 nt, synthetic construct
  misc_feature 1..1828: note = mRNA product Design i-3 comprising derived and/or modified sequence from HRSV(Memphis-37)__AIY60640.1__F_DSCav1_mut8 (opt1)
  source 1..1828: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19468 - RNA, 1828 nt, synthetic construct
  misc_feature 1..1828: note = mRNA product Design i-3 comprising derived and/or modified sequence from HRSV(Memphis-37)__AIY60640.1__F_DSCav1_mut8 (opt1)
  source 1..1828: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19469 - RNA, 1828 nt, synthetic construct
  misc_feature 1..1828: note = mRNA product Design i-3 comprising derived and/or modified sequence from HRSV(Memphis-37)__AIY60640.1__F_DSCav1_mut8 (opt2)
  source 1..1828: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19470 - RNA, 1828 nt, synthetic construct
  misc_feature 1..1828: note = mRNA product Design i-3 comprising derived and/or modified sequence from HRSV(Memphis-37)__AIY60640.1__F_DSCav1_mut8 (opt3)
  source 1..1828: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19471 - RNA, 1828 nt, synthetic construct
  misc_feature 1..1828: note = mRNA product Design i-3 comprising derived and/or modified sequence from HRSV(Memphis-37)__AIY60640.1__F_DSCav1_mut8 (opt4)
  source 1..1828: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19472 - RNA, 1828 nt, synthetic construct
  misc_feature 1..1828: note = mRNA product Design i-3 comprising derived and/or modified sequence from HRSV(Memphis-37)__AIY60640.1__F_DSCav1_mut8 (opt5)
  source 1..1828: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19473 - RNA, 1828 nt, synthetic construct
  misc_feature 1..1828: note = mRNA product Design i-3 comprising derived and/or modified sequence from HRSV(Memphis-37)__AIY60640.1__F_DSCav1_mut8 (opt6)
  source 1..1828: mol_type = other RNA
gggagaaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19474 - RNA, 1828 nt, synthetic construct
  misc_feature 1..1828: note = mRNA product Design i-3 comprising derived and/or modified sequence from HRSV(Memphis-37)__AIY60640.1__F_DSCav1_mut8 (opt11)
  source 1..1828: mol_type = other RNA
gggagaaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19475 - protein, 515 aa, synthetic construct
  REGION 1..515: note = derived and/or modified protein sequence (artificial) from HRSV(Memphis-37)__AIY60640.1__F-del_DSCav1_mut8
MELPILKTNAITTILAAVTLCFASSQNITEEFYQSTCSAVSKGYLGALRTGWYTSVITIELSNIKEIKCNGTDAKVKLIKQELDKYKNAVTDLQLLMQSTPAAGSGSAIASGIAVCKVLHLEGEVNKIKNALLSTNKAVVSLSGCGVSVLTFKVLDLKNYIDKQLLPILNKQSCSIPNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKCRGIIKTFSNGCDYVSNKGVDTVSVGNTLYYVNKQEGQSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 19476 - RNA, 1548 nt, synthetic construct
  misc_feature 1..1548: note = derived and/or modified CDS sequence (opt1) from HRSV(Memphis-37)__AIY60640.1__F-del_DSCav1_mut8
  source 1..1548: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctga

SEQ ID NO: 19477 - RNA, 1548 nt, synthetic construct
  misc_feature 1..1548: note = derived and/or modified CDS sequence (opt1) from HRSV(Memphis-37)__AIY60640.1__F-del_DSCav1_mut8
  source 1..1548: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtga

SEQ ID NO: 19478 - RNA, 1548 nt, synthetic construct
  misc_feature 1..1548: note = derived and/or modified CDS sequence (opt2) from HRSV(Memphis-37)__AIY60640.1__F-del_DSCav1_mut8
  source 1..1548: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctga

SEQ ID NO: 19479 - RNA, 1548 nt, synthetic construct
  misc_feature 1..1548: note = derived and/or modified CDS sequence (opt3) from HRSV(Memphis-37)__AIY60640.1__F-del_DSCav1_mut8
  source 1..1548: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctga

SEQ ID NO: 19480 - RNA, 1548 nt, synthetic construct
  misc_feature 1..1548: note = derived and/or modified CDS sequence (opt4) from HRSV(Memphis-37)__AIY60640.1__F-del_DSCav1_mut8
  source 1..1548: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatga

SEQ ID NO: 19481 - RNA, 1548 nt, synthetic construct
  misc_feature 1..1548: note = derived and/or modified CDS sequence (opt5) from HRSV(Memphis-37)__AIY60640.1__F-del_DSCav1_mut8
  source 1..1548: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatga

SEQ ID NO: 19482 - RNA, 1548 nt, synthetic construct
  misc_feature 1..1548: note = derived and/or modified CDS sequence (opt6) from HRSV(Memphis-37)__AIY60640.1__F-del_DSCav1_mut8
  source 1..1548: mol_type = other RNA
atggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataa

SEQ ID NO: 19483 - RNA, 1548 nt, synthetic construct
  misc_feature 1..1548: note = derived and/or modified CDS sequence (opt11) from HRSV(Memphis-37)__AIY60640.1__F-del_DSCav1_mut8
  source 1..1548: mol_type = other RNA
atggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaa

SEQ ID NO: 19484 - RNA, 1824 nt, synthetic construct
  misc_feature 1..1824: note = mRNA product Design a-1 comprising derived and/or modified sequence from HRSV(Memphis-37)__AIY60640.1__F-del_DSCav1_mut8 (opt1)
  source 1..1824: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19485 - RNA, 1824 nt, synthetic construct
  misc_feature 1..1824: note = mRNA product Design a-1 comprising derived and/or modified sequence from HRSV(Memphis-37)__AIY60640.1__F-del_DSCav1_mut8 (opt1)
  source 1..1824: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19486 - RNA, 1824 nt, synthetic construct
  misc_feature 1..1824: note = mRNA product Design a-1 comprising derived and/or modified sequence from HRSV(Memphis-37)__AIY60640.1__F-del_DSCav1_mut8 (opt2)
  source 1..1824: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19487 - RNA, 1824 nt, synthetic construct
  misc_feature 1..1824: note = mRNA product Design a-1 comprising derived and/or modified sequence from HRSV(Memphis-37)__AIY60640.1__F-del_DSCav1_mut8 (opt3)
  source 1..1824: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19488 - RNA, 1824 nt, synthetic construct
  misc_feature 1..1824: note = mRNA product Design a-1 comprising derived and/or modified sequence from HRSV(Memphis-37)__AIY60640.1__F-del_DSCav1_mut8 (opt4)
  source 1..1824: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19489 - RNA, 1824 nt, synthetic construct
  misc_feature 1..1824: note = mRNA product Design a-1 comprising derived and/or modified sequence from HRSV(Memphis-37)__AIY60640.1__F-del_DSCav1_mut8 (opt5)
  source 1..1824: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19490 - RNA, 1824 nt, synthetic construct
  misc_feature 1..1824: note = mRNA product Design a-1 comprising derived and/or modified sequence from HRSV(Memphis-37)__AIY60640.1__F-del_DSCav1_mut8 (opt6)
  source 1..1824: mol_type = other RNA
gggagagtcccgcagtcggcgtccagcggctctgcttgttcgtgtgtgtgtcgttgcaggccttattcaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19491 - RNA, 1824 nt, synthetic construct
  misc_feature 1..1824: note = mRNA product Design a-1 comprising derived and/or modified sequence from HRSV(Memphis-37)__AIY60640.1__F-del_DSCav1_mut8 (opt11)
  source 1..1824: mol_type = other RNA
gggagagtcccgcagtcggcgtccagcggctctgcttgttcgtgtgtgtgtcgttgcaggccttattcaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19492 - RNA, 1843 nt, synthetic construct
  misc_feature 1..1843: note = mRNA product Design a-2 comprising derived and/or modified sequence from HRSV(Memphis-37)__AIY60640.1__F-del_DSCav1_mut8 (opt1)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19493 - RNA, 1843 nt, synthetic construct
  misc_feature 1..1843: note = mRNA product Design a-2 comprising derived and/or modified sequence from HRSV(Memphis-37)__AIY60640.1__F-del_DSCav1_mut8 (opt1)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19494 - RNA, 1843 nt, synthetic construct
  misc_feature 1..1843: note = mRNA product Design a-2 comprising derived and/or modified sequence from HRSV(Memphis-37)__AIY60640.1__F-del_DSCav1_mut8 (opt2)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19495 - RNA, 1843 nt, synthetic construct
  misc_feature 1..1843: note = mRNA product Design a-2 comprising derived and/or modified sequence from HRSV(Memphis-37)__AIY60640.1__F-del_DSCav1_mut8 (opt3)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19496 - RNA, 1843 nt, synthetic construct
  misc_feature 1..1843: note = mRNA product Design a-2 comprising derived and/or modified sequence from HRSV(Memphis-37)__AIY60640.1__F-del_DSCav1_mut8 (opt4)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19497 - RNA, 1843 nt, synthetic construct
  misc_feature 1..1843: note = mRNA product Design a-2 comprising derived and/or modified sequence from HRSV(Memphis-37)__AIY60640.1__F-del_DSCav1_mut8 (opt5)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19498 - RNA, 1843 nt, synthetic construct
  misc_feature 1..1843: note = mRNA product Design a-2 comprising derived and/or modified sequence from HRSV(Memphis-37)__AIY60640.1__F-del_DSCav1_mut8 (opt6)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19499 - RNA, 1843 nt, synthetic construct
  misc_feature 1..1843: note = mRNA product Design a-2 comprising derived and/or modified sequence from HRSV(Memphis-37)__AIY60640.1__F-del_DSCav1_mut8 (opt11)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19500 - RNA, 1921 nt, synthetic construct
  misc_feature 1..1921: note = mRNA product Design a-3 comprising derived and/or modified sequence from HRSV(Memphis-37)__AIY60640.1__F-del_DSCav1_mut8 (opt1)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19501 - RNA, 1921 nt, synthetic construct
  misc_feature 1..1921: note = mRNA product Design a-3 comprising derived and/or modified sequence from HRSV(Memphis-37)__AIY60640.1__F-del_DSCav1_mut8 (opt1)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19502 - RNA, 1921 nt, synthetic construct
  misc_feature 1..1921: note = mRNA product Design a-3 comprising derived and/or modified sequence from HRSV(Memphis-37)__AIY60640.1__F-del_DSCav1_mut8 (opt2)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19503 - RNA, 1921 nt, synthetic construct
  misc_feature 1..1921: note = mRNA product Design a-3 comprising derived and/or modified sequence from HRSV(Memphis-37)__AIY60640.1__F-del_DSCav1_mut8 (opt3)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19504 - RNA, 1921 nt, synthetic construct
  misc_feature 1..1921: note = mRNA product Design a-3 comprising derived and/or modified sequence from HRSV(Memphis-37)__AIY60640.1__F-del_DSCav1_mut8 (opt4)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19505 - RNA, 1921 nt, synthetic construct
  misc_feature 1..1921: note = mRNA product Design a-3 comprising derived and/or modified sequence from HRSV(Memphis-37)__AIY60640.1__F-del_DSCav1_mut8 (opt5)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19506 - RNA, 1921 nt, synthetic construct
  misc_feature 1..1921: note = mRNA product Design a-3 comprising derived and/or modified sequence from HRSV(Memphis-37)__AIY60640.1__F-del_DSCav1_mut8 (opt6)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19507 - RNA, 1921 nt, synthetic construct
  misc_feature 1..1921: note = mRNA product Design a-3 comprising derived and/or modified sequence from HRSV(Memphis-37)__AIY60640.1__F-del_DSCav1_mut8 (opt11)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19508 - RNA, 1870 nt, synthetic construct
  misc_feature 1..1870: note = mRNA product Design a-4 comprising derived and/or modified sequence from HRSV(Memphis-37)__AIY60640.1__F-del_DSCav1_mut8 (opt1)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19509 - RNA, 1870 nt, synthetic construct
  misc_feature 1..1870: note = mRNA product Design a-4 comprising derived and/or modified sequence from HRSV(Memphis-37)__AIY60640.1__F-del_DSCav1_mut8 (opt1)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19510 - RNA, 1870 nt, synthetic construct
  misc_feature 1..1870: note = mRNA product Design a-4 comprising derived and/or modified sequence from HRSV(Memphis-37)__AIY60640.1__F-del_DSCav1_mut8 (opt2)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19511 - RNA, 1870 nt, synthetic construct
  misc_feature 1..1870: note = mRNA product Design a-4 comprising derived and/or modified sequence from HRSV(Memphis-37)__AIY60640.1__F-del_DSCav1_mut8 (opt3)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19512 - RNA, 1870 nt, synthetic construct
  misc_feature 1..1870: note = mRNA product Design a-4 comprising derived and/or modified sequence from HRSV(Memphis-37)__AIY60640.1__F-del_DSCav1_mut8 (opt4)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19513 - RNA, 1870 nt, synthetic construct
  misc_feature 1..1870: note = mRNA product Design a-4 comprising derived and/or modified sequence from HRSV(Memphis-37)__AIY60640.1__F-del_DSCav1_mut8 (opt5)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19514 - RNA, 1870 nt, synthetic construct
  misc_feature 1..1870: note = mRNA product Design a-4 comprising derived and/or modified sequence from HRSV(Memphis-37)__AIY60640.1__F-del_DSCav1_mut8 (opt6)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19515 - RNA, 1870 nt, synthetic construct
  misc_feature 1..1870: note = mRNA product Design a-4 comprising derived and/or modified sequence from HRSV(Memphis-37)__AIY60640.1__F-del_DSCav1_mut8 (opt11)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19516 - RNA, 1816 nt, synthetic construct
  misc_feature 1..1816: note = mRNA product Design a-5 comprising derived and/or modified sequence from HRSV(Memphis-37)__AIY60640.1__F-del_DSCav1_mut8 (opt1)
  source 1..1816: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19517 - RNA, 1816 nt, synthetic construct
  misc_feature 1..1816: note = mRNA product Design a-5 comprising derived and/or modified sequence from HRSV(Memphis-37)__AIY60640.1__F-del_DSCav1_mut8 (opt1)
  source 1..1816: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19518 - RNA, 1816 nt, synthetic construct
  misc_feature 1..1816: note = mRNA product Design a-5 comprising derived and/or modified sequence from HRSV(Memphis-37)__AIY60640.1__F-del_DSCav1_mut8 (opt2)
  source 1..1816: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19519 - RNA, 1816 nt, synthetic construct
  misc_feature 1..1816: note = mRNA product Design a-5 comprising derived and/or modified sequence from HRSV(Memphis-37)__AIY60640.1__F-del_DSCav1_mut8 (opt3)
  source 1..1816: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19520 - RNA, 1816 nt, synthetic construct
  misc_feature 1..1816: note = mRNA product Design a-5 comprising derived and/or modified sequence from HRSV(Memphis-37)__AIY60640.1__F-del_DSCav1_mut8 (opt4)
  source 1..1816: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19521 - RNA, 1816 nt, synthetic construct
  misc_feature 1..1816: note = mRNA product Design a-5 comprising derived and/or modified sequence from HRSV(Memphis-37)__AIY60640.1__F-del_DSCav1_mut8 (opt5)
  source 1..1816: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19522 - RNA, 1816 nt, synthetic construct
  misc_feature 1..1816: note = mRNA product Design a-5 comprising derived and/or modified sequence from HRSV(Memphis-37)__AIY60640.1__F-del_DSCav1_mut8 (opt6)
  source 1..1816: mol_type = other RNA
gggagactttcccattctgtagcagaatttggtgttgcctgtggtcttggtcccgcggagaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19523 - RNA, 1816 nt, synthetic construct
  misc_feature 1..1816: note = mRNA product Design a-5 comprising derived and/or modified sequence from HRSV(Memphis-37)__AIY60640.1__F-del_DSCav1_mut8 (opt11)
  source 1..1816: mol_type = other RNA
gggagactttcccattctgtagcagaatttggtgttgcctgtggtcttggtcccgcggagaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19524 - RNA, 1997 nt, synthetic construct
  misc_feature 1..1997: note = mRNA product Design b-1 comprising derived and/or modified sequence from HRSV(Memphis-37)__AIY60640.1__F-del_DSCav1_mut8 (opt1)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19525 - RNA, 1997 nt, synthetic construct
  misc_feature 1..1997: note = mRNA product Design b-1 comprising derived and/or modified sequence from HRSV(Memphis-37)__AIY60640.1__F-del_DSCav1_mut8 (opt1)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19526 - RNA, 1997 nt, synthetic construct
  misc_feature 1..1997: note = mRNA product Design b-1 comprising derived and/or modified sequence from HRSV(Memphis-37)__AIY60640.1__F-del_DSCav1_mut8 (opt2)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19527 - RNA, 1997 nt, synthetic construct
  misc_feature 1..1997: note = mRNA product Design b-1 comprising derived and/or modified sequence from HRSV(Memphis-37)__AIY60640.1__F-del_DSCav1_mut8 (opt3)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19528 - RNA, 1997 nt, synthetic construct
  misc_feature 1..1997: note = mRNA product Design b-1 comprising derived and/or modified sequence from HRSV(Memphis-37)__AIY60640.1__F-del_DSCav1_mut8 (opt4)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19529 - RNA, 1997 nt, synthetic construct
  misc_feature 1..1997: note = mRNA product Design b-1 comprising derived and/or modified sequence from HRSV(Memphis-37)__AIY60640.1__F-del_DSCav1_mut8 (opt5)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19530 - RNA, 1997 nt, synthetic construct
  misc_feature 1..1997: note = mRNA product Design b-1 comprising derived and/or modified sequence from HRSV(Memphis-37)__AIY60640.1__F-del_DSCav1_mut8 (opt6)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19531 - RNA, 1997 nt, synthetic construct
  misc_feature 1..1997: note = mRNA product Design b-1 comprising derived and/or modified sequence from HRSV(Memphis-37)__AIY60640.1__F-del_DSCav1_mut8 (opt11)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19532 - RNA, 1817 nt, synthetic construct
  misc_feature 1..1817: note = mRNA product Design b-2 comprising derived and/or modified sequence from HRSV(Memphis-37)__AIY60640.1__F-del_DSCav1_mut8 (opt1)
  source 1..1817: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19533 - RNA, 1817 nt, synthetic construct
  misc_feature 1..1817: note = mRNA product Design b-2 comprising derived and/or modified sequence from HRSV(Memphis-37)__AIY60640.1__F-del_DSCav1_mut8 (opt1)
  source 1..1817: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19534 - RNA, 1817 nt, synthetic construct
  misc_feature 1..1817: note = mRNA product Design b-2 comprising derived and/or modified sequence from HRSV(Memphis-37)__AIY60640.1__F-del_DSCav1_mut8 (opt2)
  source 1..1817: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19535 - RNA, 1817 nt, synthetic construct
  misc_feature 1..1817: note = mRNA product Design b-2 comprising derived and/or modified sequence from HRSV(Memphis-37)__AIY60640.1__F-del_DSCav1_mut8 (opt3)
  source 1..1817: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19536 - RNA, 1817 nt, synthetic construct
  misc_feature 1..1817: note = mRNA product Design b-2 comprising derived and/or modified sequence from HRSV(Memphis-37)__AIY60640.1__F-del_DSCav1_mut8 (opt4)
  source 1..1817: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19537 - RNA, 1817 nt, synthetic construct
  misc_feature 1..1817: note = mRNA product Design b-2 comprising derived and/or modified sequence from HRSV(Memphis-37)__AIY60640.1__F-del_DSCav1_mut8 (opt5)
  source 1..1817: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19538 - RNA, 1817 nt, synthetic construct
  misc_feature 1..1817: note = mRNA product Design b-2 comprising derived and/or modified sequence from HRSV(Memphis-37)__AIY60640.1__F-del_DSCav1_mut8 (opt6)
  source 1..1817: mol_type = other RNA
gggagagcctctgctggagtccggggagtggcgttggctgctagagcgaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19539 - RNA, 1817 nt, synthetic construct
  misc_feature 1..1817: note = mRNA product Design b-2 comprising derived and/or modified sequence from HRSV(Memphis-37)__AIY60640.1__F-del_DSCav1_mut8 (opt11)
  source 1..1817: mol_type = other RNA
gggagagcctctgctggagtccggggagtggcgttggctgctagagcgaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19540 - RNA, 1837 nt, synthetic construct
  misc_feature 1..1837: note = mRNA product Design b-3 comprising derived and/or modified sequence from HRSV(Memphis-37)__AIY60640.1__F-del_DSCav1_mut8 (opt1)
  source 1..1837: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19541 - RNA, 1837 nt, synthetic construct
  misc_feature 1..1837: note = mRNA product Design b-3 comprising derived and/or modified sequence from HRSV(Memphis-37)__AIY60640.1__F-del_DSCav1_mut8 (opt1)
  source 1..1837: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19542 - RNA, 1837 nt, synthetic construct
  misc_feature 1..1837: note = mRNA product Design b-3 comprising derived and/or modified sequence from HRSV(Memphis-37)__AIY60640.1__F-del_DSCav1_mut8 (opt2)
  source 1..1837: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19543 - RNA, 1837 nt, synthetic construct
  misc_feature 1..1837: note = mRNA product Design b-3 comprising derived and/or modified sequence from HRSV(Memphis-37)__AIY60640.1__F-del_DSCav1_mut8 (opt3)
  source 1..1837: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19544 - RNA, 1837 nt, synthetic construct
  misc_feature 1..1837: note = mRNA product Design b-3 comprising derived and/or modified sequence from HRSV(Memphis-37)__AIY60640.1__F-del_DSCav1_mut8 (opt4)
  source 1..1837: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19545 - RNA, 1837 nt, synthetic construct
  misc_feature 1..1837: note = mRNA product Design b-3 comprising derived and/or modified sequence from HRSV(Memphis-37)__AIY60640.1__F-del_DSCav1_mut8 (opt5)
  source 1..1837: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19546 - RNA, 1837 nt, synthetic construct
  misc_feature 1..1837: note = mRNA product Design b-3 comprising derived and/or modified sequence from HRSV(Memphis-37)__AIY60640.1__F-del_DSCav1_mut8 (opt6)
  source 1..1837: mol_type = other RNA
gggagagtcccgcagtcggcgtccagcggctctgcttgttcgtgtgtgtgtcgttgcaggccttattcaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19547 - RNA, 1837 nt, synthetic construct
  misc_feature 1..1837: note = mRNA product Design b-3 comprising derived and/or modified sequence from HRSV(Memphis-37)__AIY60640.1__F-del_DSCav1_mut8 (opt11)
  source 1..1837: mol_type = other RNA
gggagagtcccgcagtcggcgtccagcggctctgcttgttcgtgtgtgtgtcgttgcaggccttattcaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19548 - RNA, 1888 nt, synthetic construct
  misc_feature 1..1888: note = mRNA product Design b-4 comprising derived and/or modified sequence from HRSV(Memphis-37)__AIY60640.1__F-del_DSCav1_mut8 (opt1)
  source 1..1888: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19549 - RNA, 1888 nt, synthetic construct
  misc_feature 1..1888: note = mRNA product Design b-4 comprising derived and/or modified sequence from HRSV(Memphis-37)__AIY60640.1__F-del_DSCav1_mut8 (opt1)
  source 1..1888: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19550 - RNA, 1888 nt, synthetic construct
  misc_feature 1..1888: note = mRNA product Design b-4 comprising derived and/or modified sequence from HRSV(Memphis-37)__AIY60640.1__F-del_DSCav1_mut8 (opt2)
  source 1..1888: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19551 - RNA, 1888 nt, synthetic construct
  misc_feature 1..1888: note = mRNA product Design b-4 comprising derived and/or modified sequence from HRSV(Memphis-37)__AIY60640.1__F-del_DSCav1_mut8 (opt3)
  source 1..1888: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19552 - RNA, 1888 nt, synthetic construct
  misc_feature 1..1888: note = mRNA product Design b-4 comprising derived and/or modified sequence from HRSV(Memphis-37)__AIY60640.1__F-del_DSCav1_mut8 (opt4)
  source 1..1888: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19553 - RNA, 1888 nt, synthetic construct
  misc_feature 1..1888: note = mRNA product Design b-4 comprising derived and/or modified sequence from HRSV(Memphis-37)__AIY60640.1__F-del_DSCav1_mut8 (opt5)
  source 1..1888: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19554 - RNA, 1888 nt, synthetic construct
  misc_feature 1..1888: note = mRNA product Design b-4 comprising derived and/or modified sequence from HRSV(Memphis-37)__AIY60640.1__F-del_DSCav1_mut8 (opt6)
  source 1..1888: mol_type = other RNA
gggagagtcccgcagtcggcgtccagcggctctgcttgttcgtgtgtgtgtcgttgcaggccttattcaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19555 - RNA, 1888 nt, synthetic construct
  misc_feature 1..1888: note = mRNA product Design b-4 comprising derived and/or modified sequence from HRSV(Memphis-37)__AIY60640.1__F-del_DSCav1_mut8 (opt11)
  source 1..1888: mol_type = other RNA
gggagagtcccgcagtcggcgtccagcggctctgcttgttcgtgtgtgtgtcgttgcaggccttattcaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19556 - RNA, 1950 nt, synthetic construct
  misc_feature 1..1950: note = mRNA product Design b-5 comprising derived and/or modified sequence from HRSV(Memphis-37)__AIY60640.1__F-del_DSCav1_mut8 (opt1)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19557 - RNA, 1950 nt, synthetic construct
  misc_feature 1..1950: note = mRNA product Design b-5 comprising derived and/or modified sequence from HRSV(Memphis-37)__AIY60640.1__F-del_DSCav1_mut8 (opt1)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19558 - RNA, 1950 nt, synthetic construct
  misc_feature 1..1950: note = mRNA product Design b-5 comprising derived and/or modified sequence from HRSV(Memphis-37)__AIY60640.1__F-del_DSCav1_mut8 (opt2)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19559 - RNA, 1950 nt, synthetic construct
  misc_feature 1..1950: note = mRNA product Design b-5 comprising derived and/or modified sequence from HRSV(Memphis-37)__AIY60640.1__F-del_DSCav1_mut8 (opt3)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19560 - RNA, 1950 nt, synthetic construct
  misc_feature 1..1950: note = mRNA product Design b-5 comprising derived and/or modified sequence from HRSV(Memphis-37)__AIY60640.1__F-del_DSCav1_mut8 (opt4)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19561 - RNA, 1950 nt, synthetic construct
  misc_feature 1..1950: note = mRNA product Design b-5 comprising derived and/or modified sequence from HRSV(Memphis-37)__AIY60640.1__F-del_DSCav1_mut8 (opt5)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19562 - RNA, 1950 nt, synthetic construct
  misc_feature 1..1950: note = mRNA product Design b-5 comprising derived and/or modified sequence from HRSV(Memphis-37)__AIY60640.1__F-del_DSCav1_mut8 (opt6)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19563 - RNA, 1950 nt, synthetic construct
  misc_feature 1..1950: note = mRNA product Design b-5 comprising derived and/or modified sequence from HRSV(Memphis-37)__AIY60640.1__F-del_DSCav1_mut8 (opt11)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19564 - RNA, 1856 nt, synthetic construct
  misc_feature 1..1856: note = mRNA product Design c-1 comprising derived and/or modified sequence from HRSV(Memphis-37)__AIY60640.1__F-del_DSCav1_mut8 (opt1)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19565 - RNA, 1856 nt, synthetic construct
  misc_feature 1..1856: note = mRNA product Design c-1 comprising derived and/or modified sequence from HRSV(Memphis-37)__AIY60640.1__F-del_DSCav1_mut8 (opt1)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19566 - RNA, 1856 nt, synthetic construct
  misc_feature 1..1856: note = mRNA product Design c-1 comprising derived and/or modified sequence from HRSV(Memphis-37)__AIY60640.1__F-del_DSCav1_mut8 (opt2)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19567 - RNA, 1856 nt, synthetic construct
  misc_feature 1..1856: note = mRNA product Design c-1 comprising derived and/or modified sequence from HRSV(Memphis-37)__AIY60640.1__F-del_DSCav1_mut8 (opt3)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19568 - RNA, 1856 nt, synthetic construct
  misc_feature 1..1856: note = mRNA product Design c-1 comprising derived and/or modified sequence from HRSV(Memphis-37)__AIY60640.1__F-del_DSCav1_mut8 (opt4)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19569 - RNA, 1856 nt, synthetic construct
  misc_feature 1..1856: note = mRNA product Design c-1 comprising derived and/or modified sequence from HRSV(Memphis-37)__AIY60640.1__F-del_DSCav1_mut8 (opt5)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19570 - RNA, 1856 nt, synthetic construct
  misc_feature 1..1856: note = mRNA product Design c-1 comprising derived and/or modified sequence from HRSV(Memphis-37)__AIY60640.1__F-del_DSCav1_mut8 (opt6)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19571 - RNA, 1856 nt, synthetic construct
  misc_feature 1..1856: note = mRNA product Design c-1 comprising derived and/or modified sequence from HRSV(Memphis-37)__AIY60640.1__F-del_DSCav1_mut8 (opt11)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19572 - RNA, 1946 nt, synthetic construct
  misc_feature 1..1946: note = mRNA product Design c-2 comprising derived and/or modified sequence from HRSV(Memphis-37)__AIY60640.1__F-del_DSCav1_mut8 (opt1)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19573 - RNA, 1946 nt, synthetic construct
  misc_feature 1..1946: note = mRNA product Design c-2 comprising derived and/or modified sequence from HRSV(Memphis-37)__AIY60640.1__F-del_DSCav1_mut8 (opt1)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19574 - RNA, 1946 nt, synthetic construct
  misc_feature 1..1946: note = mRNA product Design c-2 comprising derived and/or modified sequence from HRSV(Memphis-37)__AIY60640.1__F-del_DSCav1_mut8 (opt2)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19575 - RNA, 1946 nt, synthetic construct
  misc_feature 1..1946: note = mRNA product Design c-2 comprising derived and/or modified sequence from HRSV(Memphis-37)__AIY60640.1__F-del_DSCav1_mut8 (opt3)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19576 - RNA, 1946 nt, synthetic construct
  misc_feature 1..1946: note = mRNA product Design c-2 comprising derived and/or modified sequence from HRSV(Memphis-37)__AIY60640.1__F-del_DSCav1_mut8 (opt4)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19577 - RNA, 1946 nt, synthetic construct
  misc_feature 1..1946: note = mRNA product Design c-2 comprising derived and/or modified sequence from HRSV(Memphis-37)__AIY60640.1__F-del_DSCav1_mut8 (opt5)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19578 - RNA, 1946 nt, synthetic construct
  misc_feature 1..1946: note = mRNA product Design c-2 comprising derived and/or modified sequence from HRSV(Memphis-37)__AIY60640.1__F-del_DSCav1_mut8 (opt6)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19579 - RNA, 1946 nt, synthetic construct
  misc_feature 1..1946: note = mRNA product Design c-2 comprising derived and/or modified sequence from HRSV(Memphis-37)__AIY60640.1__F-del_DSCav1_mut8 (opt11)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19580 - RNA, 1923 nt, synthetic construct
  misc_feature 1..1923: note = mRNA product Design c-3 comprising derived and/or modified sequence from HRSV(Memphis-37)__AIY60640.1__F-del_DSCav1_mut8 (opt1)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19581 - RNA, 1923 nt, synthetic construct
  misc_feature 1..1923: note = mRNA product Design c-3 comprising derived and/or modified sequence from HRSV(Memphis-37)__AIY60640.1__F-del_DSCav1_mut8 (opt1)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19582 - RNA, 1923 nt, synthetic construct
  misc_feature 1..1923: note = mRNA product Design c-3 comprising derived and/or modified sequence from HRSV(Memphis-37)__AIY60640.1__F-del_DSCav1_mut8 (opt2)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19583 - RNA, 1923 nt, synthetic construct
  misc_feature 1..1923: note = mRNA product Design c-3 comprising derived and/or modified sequence from HRSV(Memphis-37)__AIY60640.1__F-del_DSCav1_mut8 (opt3)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19584 - RNA, 1923 nt, synthetic construct
  misc_feature 1..1923: note = mRNA product Design c-3 comprising derived and/or modified sequence from HRSV(Memphis-37)__AIY60640.1__F-del_DSCav1_mut8 (opt4)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19585 - RNA, 1923 nt, synthetic construct
  misc_feature 1..1923: note = mRNA product Design c-3 comprising derived and/or modified sequence from HRSV(Memphis-37)__AIY60640.1__F-del_DSCav1_mut8 (opt5)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19586 - RNA, 1923 nt, synthetic construct
  misc_feature 1..1923: note = mRNA product Design c-3 comprising derived and/or modified sequence from HRSV(Memphis-37)__AIY60640.1__F-del_DSCav1_mut8 (opt6)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19587 - RNA, 1923 nt, synthetic construct
  misc_feature 1..1923: note = mRNA product Design c-3 comprising derived and/or modified sequence from HRSV(Memphis-37)__AIY60640.1__F-del_DSCav1_mut8 (opt11)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19588 - RNA, 1919 nt, synthetic construct
  misc_feature 1..1919: note = mRNA product Design c-4 comprising derived and/or modified sequence from HRSV(Memphis-37)__AIY60640.1__F-del_DSCav1_mut8 (opt1)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19589 - RNA, 1919 nt, synthetic construct
  misc_feature 1..1919: note = mRNA product Design c-4 comprising derived and/or modified sequence from HRSV(Memphis-37)__AIY60640.1__F-del_DSCav1_mut8 (opt1)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19590 - RNA, 1919 nt, synthetic construct
  misc_feature 1..1919: note = mRNA product Design c-4 comprising derived and/or modified sequence from HRSV(Memphis-37)__AIY60640.1__F-del_DSCav1_mut8 (opt2)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19591 - RNA, 1919 nt, synthetic construct
  misc_feature 1..1919: note = mRNA product Design c-4 comprising derived and/or modified sequence from HRSV(Memphis-37)__AIY60640.1__F-del_DSCav1_mut8 (opt3)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19592 - RNA, 1919 nt, synthetic construct
  misc_feature 1..1919: note = mRNA product Design c-4 comprising derived and/or modified sequence from HRSV(Memphis-37)__AIY60640.1__F-del_DSCav1_mut8 (opt4)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19593 - RNA, 1919 nt, synthetic construct
  misc_feature 1..1919: note = mRNA product Design c-4 comprising derived and/or modified sequence from HRSV(Memphis-37)__AIY60640.1__F-del_DSCav1_mut8 (opt5)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19594 - RNA, 1919 nt, synthetic construct
  misc_feature 1..1919: note = mRNA product Design c-4 comprising derived and/or modified sequence from HRSV(Memphis-37)__AIY60640.1__F-del_DSCav1_mut8 (opt6)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19595 - RNA, 1919 nt, synthetic construct
  misc_feature 1..1919: note = mRNA product Design c-4 comprising derived and/or modified sequence from HRSV(Memphis-37)__AIY60640.1__F-del_DSCav1_mut8 (opt11)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19596 - RNA, 1837 nt, synthetic construct
  misc_feature 1..1837: note = mRNA product Design c-5 comprising derived and/or modified sequence from HRSV(Memphis-37)__AIY60640.1__F-del_DSCav1_mut8 (opt1)
  source 1..1837: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19597 - RNA, 1837 nt, synthetic construct
  misc_feature 1..1837: note = mRNA product Design c-5 comprising derived and/or modified sequence from HRSV(Memphis-37)__AIY60640.1__F-del_DSCav1_mut8 (opt1)
  source 1..1837: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19598 - RNA, 1837 nt, synthetic construct
  misc_feature 1..1837: note = mRNA product Design c-5 comprising derived and/or modified sequence from HRSV(Memphis-37)__AIY60640.1__F-del_DSCav1_mut8 (opt2)
  source 1..1837: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19599 - RNA, 1837 nt, synthetic construct
  misc_feature 1..1837: note = mRNA product Design c-5 comprising derived and/or modified sequence from HRSV(Memphis-37)__AIY60640.1__F-del_DSCav1_mut8 (opt3)
  source 1..1837: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19600 - RNA, 1837 nt, synthetic construct
  misc_feature 1..1837: note = mRNA product Design c-5 comprising derived and/or modified sequence from HRSV(Memphis-37)__AIY60640.1__F-del_DSCav1_mut8 (opt4)
  source 1..1837: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19601 - RNA, 1837 nt, synthetic construct
  misc_feature 1..1837: note = mRNA product Design c-5 comprising derived and/or modified sequence from HRSV(Memphis-37)__AIY60640.1__F-del_DSCav1_mut8 (opt5)
  source 1..1837: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19602 - RNA, 1837 nt, synthetic construct
  misc_feature 1..1837: note = mRNA product Design c-5 comprising derived and/or modified sequence from HRSV(Memphis-37)__AIY60640.1__F-del_DSCav1_mut8 (opt6)
  source 1..1837: mol_type = other RNA
gggagagcggctcggccattttgtcccagtcagtccggaggctgcggctgcagaagtaccgcctgcggagtaactgcaaagaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19603 - RNA, 1837 nt, synthetic construct
  misc_feature 1..1837: note = mRNA product Design c-5 comprising derived and/or modified sequence from HRSV(Memphis-37)__AIY60640.1__F-del_DSCav1_mut8 (opt11)
  source 1..1837: mol_type = other RNA
gggagagcggctcggccattttgtcccagtcagtccggaggctgcggctgcagaagtaccgcctgcggagtaactgcaaagaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19604 - RNA, 1846 nt, synthetic construct
  misc_feature 1..1846: note = mRNA product Design d-1 comprising derived and/or modified sequence from HRSV(Memphis-37)__AIY60640.1__F-del_DSCav1_mut8 (opt1)
  source 1..1846: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19605 - RNA, 1846 nt, synthetic construct
  misc_feature 1..1846: note = mRNA product Design d-1 comprising derived and/or modified sequence from HRSV(Memphis-37)__AIY60640.1__F-del_DSCav1_mut8 (opt1)
  source 1..1846: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19606 - RNA, 1846 nt, synthetic construct
  misc_feature 1..1846: note = mRNA product Design d-1 comprising derived and/or modified sequence from HRSV(Memphis-37)__AIY60640.1__F-del_DSCav1_mut8 (opt2)
  source 1..1846: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19607 - RNA, 1846 nt, synthetic construct
  misc_feature 1..1846: note = mRNA product Design d-1 comprising derived and/or modified sequence from HRSV(Memphis-37)__AIY60640.1__F-del_DSCav1_mut8 (opt3)
  source 1..1846: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19608 - RNA, 1846 nt, synthetic construct
  misc_feature 1..1846: note = mRNA product Design d-1 comprising derived and/or modified sequence from HRSV(Memphis-37)__AIY60640.1__F-del_DSCav1_mut8 (opt4)
  source 1..1846: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19609 - RNA, 1846 nt, synthetic construct
  misc_feature 1..1846: note = mRNA product Design d-1 comprising derived and/or modified sequence from HRSV(Memphis-37)__AIY60640.1__F-del_DSCav1_mut8 (opt5)
  source 1..1846: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19610 - RNA, 1846 nt, synthetic construct
  misc_feature 1..1846: note = mRNA product Design d-1 comprising derived and/or modified sequence from HRSV(Memphis-37)__AIY60640.1__F-del_DSCav1_mut8 (opt6)
  source 1..1846: mol_type = other RNA
gggagacccgtgacccggaagttgtacggctacgcgactttccctcccacaaaccctcgcgcccttcctttcctacttgggcccggcagaaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19611 - RNA, 1846 nt, synthetic construct
  misc_feature 1..1846: note = mRNA product Design d-1 comprising derived and/or modified sequence from HRSV(Memphis-37)__AIY60640.1__F-del_DSCav1_mut8 (opt11)
  source 1..1846: mol_type = other RNA
gggagacccgtgacccggaagttgtacggctacgcgactttccctcccacaaaccctcgcgcccttcctttcctacttgggcccggcagaaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19612 - RNA, 1901 nt, synthetic construct
  misc_feature 1..1901: note = mRNA product Design d-2 comprising derived and/or modified sequence from HRSV(Memphis-37)__AIY60640.1__F-del_DSCav1_mut8 (opt1)
  source 1..1901: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19613 - RNA, 1901 nt, synthetic construct
  misc_feature 1..1901: note = mRNA product Design d-2 comprising derived and/or modified sequence from HRSV(Memphis-37)__AIY60640.1__F-del_DSCav1_mut8 (opt1)
  source 1..1901: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19614 - RNA, 1901 nt, synthetic construct
  misc_feature 1..1901: note = mRNA product Design d-2 comprising derived and/or modified sequence from HRSV(Memphis-37)__AIY60640.1__F-del_DSCav1_mut8 (opt2)
  source 1..1901: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19615 - RNA, 1901 nt, synthetic construct
  misc_feature 1..1901: note = mRNA product Design d-2 comprising derived and/or modified sequence from HRSV(Memphis-37)__AIY60640.1__F-del_DSCav1_mut8 (opt3)
  source 1..1901: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19616 - RNA, 1901 nt, synthetic construct
  misc_feature 1..1901: note = mRNA product Design d-2 comprising derived and/or modified sequence from HRSV(Memphis-37)__AIY60640.1__F-del_DSCav1_mut8 (opt4)
  source 1..1901: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19617 - RNA, 1901 nt, synthetic construct
  misc_feature 1..1901: note = mRNA product Design d-2 comprising derived and/or modified sequence from HRSV(Memphis-37)__AIY60640.1__F-del_DSCav1_mut8 (opt5)
  source 1..1901: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19618 - RNA, 1901 nt, synthetic construct
  misc_feature 1..1901: note = mRNA product Design d-2 comprising derived and/or modified sequence from HRSV(Memphis-37)__AIY60640.1__F-del_DSCav1_mut8 (opt6)
  source 1..1901: mol_type = other RNA
gggagagcggctcggccattttgtcccagtcagtccggaggctgcggctgcagaagtaccgcctgcggagtaactgcaaagaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19619 - RNA, 1901 nt, synthetic construct
  misc_feature 1..1901: note = mRNA product Design d-2 comprising derived and/or modified sequence from HRSV(Memphis-37)__AIY60640.1__F-del_DSCav1_mut8 (opt11)
  source 1..1901: mol_type = other RNA
gggagagcggctcggccattttgtcccagtcagtccggaggctgcggctgcagaagtaccgcctgcggagtaactgcaaagaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19620 - RNA, 2217 nt, synthetic construct
  misc_feature 1..2217: note = mRNA product Design d-3 comprising derived and/or modified sequence from HRSV(Memphis-37)__AIY60640.1__F-del_DSCav1_mut8 (opt1)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19621 - RNA, 2217 nt, synthetic construct
  misc_feature 1..2217: note = mRNA product Design d-3 comprising derived and/or modified sequence from HRSV(Memphis-37)__AIY60640.1__F-del_DSCav1_mut8 (opt1)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19622 - RNA, 2217 nt, synthetic construct
  misc_feature 1..2217: note = mRNA product Design d-3 comprising derived and/or modified sequence from HRSV(Memphis-37)__AIY60640.1__F-del_DSCav1_mut8 (opt2)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19623 - RNA, 2217 nt, synthetic construct
  misc_feature 1..2217: note = mRNA product Design d-3 comprising derived and/or modified sequence from HRSV(Memphis-37)__AIY60640.1__F-del_DSCav1_mut8 (opt3)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19624 - RNA, 2217 nt, synthetic construct
  misc_feature 1..2217: note = mRNA product Design d-3 comprising derived and/or modified sequence from HRSV(Memphis-37)__AIY60640.1__F-del_DSCav1_mut8 (opt4)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19625 - RNA, 2217 nt, synthetic construct
  misc_feature 1..2217: note = mRNA product Design d-3 comprising derived and/or modified sequence from HRSV(Memphis-37)__AIY60640.1__F-del_DSCav1_mut8 (opt5)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19626 - RNA, 2217 nt, synthetic construct
  misc_feature 1..2217: note = mRNA product Design d-3 comprising derived and/or modified sequence from HRSV(Memphis-37)__AIY60640.1__F-del_DSCav1_mut8 (opt6)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19627 - RNA, 2217 nt, synthetic construct
  misc_feature 1..2217: note = mRNA product Design d-3 comprising derived and/or modified sequence from HRSV(Memphis-37)__AIY60640.1__F-del_DSCav1_mut8 (opt11)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19628 - RNA, 1900 nt, synthetic construct
  misc_feature 1..1900: note = mRNA product Design d-4 comprising derived and/or modified sequence from HRSV(Memphis-37)__AIY60640.1__F-del_DSCav1_mut8 (opt1)
  source 1..1900: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19629 - RNA, 1900 nt, synthetic construct
  misc_feature 1..1900: note = mRNA product Design d-4 comprising derived and/or modified sequence from HRSV(Memphis-37)__AIY60640.1__F-del_DSCav1_mut8 (opt1)
  source 1..1900: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19630 - RNA, 1900 nt, synthetic construct
  misc_feature 1..1900: note = mRNA product Design d-4 comprising derived and/or modified sequence from HRSV(Memphis-37)__AIY60640.1__F-del_DSCav1_mut8 (opt2)
  source 1..1900: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19631 - RNA, 1900 nt, synthetic construct
  misc_feature 1..1900: note = mRNA product Design d-4 comprising derived and/or modified sequence from HRSV(Memphis-37)__AIY60640.1__F-del_DSCav1_mut8 (opt3)
  source 1..1900: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19632 - RNA, 1900 nt, synthetic construct
  misc_feature 1..1900: note = mRNA product Design d-4 comprising derived and/or modified sequence from HRSV(Memphis-37)__AIY60640.1__F-del_DSCav1_mut8 (opt4)
  source 1..1900: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19633 - RNA, 1900 nt, synthetic construct
  misc_feature 1..1900: note = mRNA product Design d-4 comprising derived and/or modified sequence from HRSV(Memphis-37)__AIY60640.1__F-del_DSCav1_mut8 (opt5)
  source 1..1900: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19634 - RNA, 1900 nt, synthetic construct
  misc_feature 1..1900: note = mRNA product Design d-4 comprising derived and/or modified sequence from HRSV(Memphis-37)__AIY60640.1__F-del_DSCav1_mut8 (opt6)
  source 1..1900: mol_type = other RNA
gggagagtcccgcagtcggcgtccagcggctctgcttgttcgtgtgtgtgtcgttgcaggccttattcaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19635 - RNA, 1900 nt, synthetic construct
  misc_feature 1..1900: note = mRNA product Design d-4 comprising derived and/or modified sequence from HRSV(Memphis-37)__AIY60640.1__F-del_DSCav1_mut8 (opt11)
  source 1..1900: mol_type = other RNA
gggagagtcccgcagtcggcgtccagcggctctgcttgttcgtgtgtgtgtcgttgcaggccttattcaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19636 - RNA, 1997 nt, synthetic construct
  misc_feature 1..1997: note = mRNA product Design d-5 comprising derived and/or modified sequence from HRSV(Memphis-37)__AIY60640.1__F-del_DSCav1_mut8 (opt1)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19637 - RNA, 1997 nt, synthetic construct
  misc_feature 1..1997: note = mRNA product Design d-5 comprising derived and/or modified sequence from HRSV(Memphis-37)__AIY60640.1__F-del_DSCav1_mut8 (opt1)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19638 - RNA, 1997 nt, synthetic construct
  misc_feature 1..1997: note = mRNA product Design d-5 comprising derived and/or modified sequence from HRSV(Memphis-37)__AIY60640.1__F-del_DSCav1_mut8 (opt2)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19639 - RNA, 1997 nt, synthetic construct
  misc_feature 1..1997: note = mRNA product Design d-5 comprising derived and/or modified sequence from HRSV(Memphis-37)__AIY60640.1__F-del_DSCav1_mut8 (opt3)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19640 - RNA, 1997 nt, synthetic construct
  misc_feature 1..1997: note = mRNA product Design d-5 comprising derived and/or modified sequence from HRSV(Memphis-37)__AIY60640.1__F-del_DSCav1_mut8 (opt4)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19641 - RNA, 1997 nt, synthetic construct
  misc_feature 1..1997: note = mRNA product Design d-5 comprising derived and/or modified sequence from HRSV(Memphis-37)__AIY60640.1__F-del_DSCav1_mut8 (opt5)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19642 - RNA, 1997 nt, synthetic construct
  misc_feature 1..1997: note = mRNA product Design d-5 comprising derived and/or modified sequence from HRSV(Memphis-37)__AIY60640.1__F-del_DSCav1_mut8 (opt6)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19643 - RNA, 1997 nt, synthetic construct
  misc_feature 1..1997: note = mRNA product Design d-5 comprising derived and/or modified sequence from HRSV(Memphis-37)__AIY60640.1__F-del_DSCav1_mut8 (opt11)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19644 - RNA, 1877 nt, synthetic construct
  misc_feature 1..1877: note = mRNA product Design e-1 comprising derived and/or modified sequence from HRSV(Memphis-37)__AIY60640.1__F-del_DSCav1_mut8 (opt1)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19645 - RNA, 1877 nt, synthetic construct
  misc_feature 1..1877: note = mRNA product Design e-1 comprising derived and/or modified sequence from HRSV(Memphis-37)__AIY60640.1__F-del_DSCav1_mut8 (opt1)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19646 - RNA, 1877 nt, synthetic construct
  misc_feature 1..1877: note = mRNA product Design e-1 comprising derived and/or modified sequence from HRSV(Memphis-37)__AIY60640.1__F-del_DSCav1_mut8 (opt2)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19647 - RNA, 1877 nt, synthetic construct
  misc_feature 1..1877: note = mRNA product Design e-1 comprising derived and/or modified sequence from HRSV(Memphis-37)__AIY60640.1__F-del_DSCav1_mut8 (opt3)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19648 - RNA, 1877 nt, synthetic construct
  misc_feature 1..1877: note = mRNA product Design e-1 comprising derived and/or modified sequence from HRSV(Memphis-37)__AIY60640.1__F-del_DSCav1_mut8 (opt4)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19649 - RNA, 1877 nt, synthetic construct
  misc_feature 1..1877: note = mRNA product Design e-1 comprising derived and/or modified sequence from HRSV(Memphis-37)__AIY60640.1__F-del_DSCav1_mut8 (opt5)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19650 - RNA, 1877 nt, synthetic construct
  misc_feature 1..1877: note = mRNA product Design e-1 comprising derived and/or modified sequence from HRSV(Memphis-37)__AIY60640.1__F-del_DSCav1_mut8 (opt6)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19651 - RNA, 1877 nt, synthetic construct
  misc_feature 1..1877: note = mRNA product Design e-1 comprising derived and/or modified sequence from HRSV(Memphis-37)__AIY60640.1__F-del_DSCav1_mut8 (opt11)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19652 - RNA, 1859 nt, synthetic construct
  misc_feature 1..1859: note = mRNA product Design e-2 comprising derived and/or modified sequence from HRSV(Memphis-37)__AIY60640.1__F-del_DSCav1_mut8 (opt1)
  source 1..1859: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19653 - RNA, 1859 nt, synthetic construct
  misc_feature 1..1859: note = mRNA product Design e-2 comprising derived and/or modified sequence from HRSV(Memphis-37)__AIY60640.1__F-del_DSCav1_mut8 (opt1)
  source 1..1859: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19654 - RNA, 1859 nt, synthetic construct
  misc_feature 1..1859: note = mRNA product Design e-2 comprising derived and/or modified sequence from HRSV(Memphis-37)__AIY60640.1__F-del_DSCav1_mut8 (opt2)
  source 1..1859: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19655 - RNA, 1859 nt, synthetic construct
  misc_feature 1..1859: note = mRNA product Design e-2 comprising derived and/or modified sequence from HRSV(Memphis-37)__AIY60640.1__F-del_DSCav1_mut8 (opt3)
  source 1..1859: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19656 - RNA, 1859 nt, synthetic construct
  misc_feature 1..1859: note = mRNA product Design e-2 comprising derived and/or modified sequence from HRSV(Memphis-37)__AIY60640.1__F-del_DSCav1_mut8 (opt4)
  source 1..1859: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19657 - RNA, 1859 nt, synthetic construct
  misc_feature 1..1859: note = mRNA product Design e-2 comprising derived and/or modified sequence from HRSV(Memphis-37)__AIY60640.1__F-del_DSCav1_mut8 (opt5)
  source 1..1859: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19658 - RNA, 1859 nt, synthetic construct
  misc_feature 1..1859: note = mRNA product Design e-2 comprising derived and/or modified sequence from HRSV(Memphis-37)__AIY60640.1__F-del_DSCav1_mut8 (opt6)
  source 1..1859: mol_type = other RNA
gggagacccgtgacccggaagttgtacggctacgcgactttccctcccacaaaccctcgcgcccttcctttcctacttgggcccggcagaaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19659 - RNA, 1859 nt, synthetic construct
  misc_feature 1..1859: note = mRNA product Design e-2 comprising derived and/or modified sequence from HRSV(Memphis-37)__AIY60640.1__F-del_DSCav1_mut8 (opt11)
  source 1..1859: mol_type = other RNA
gggagacccgtgacccggaagttgtacggctacgcgactttccctcccacaaaccctcgcgcccttcctttcctacttgggcccggcagaaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19660 - RNA, 1829 nt, synthetic construct
  misc_feature 1..1829: note = mRNA product Design e-3 comprising derived and/or modified sequence from HRSV(Memphis-37)__AIY60640.1__F-del_DSCav1_mut8 (opt1)
  source 1..1829: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19661 - RNA, 1829 nt, synthetic construct
  misc_feature 1..1829: note = mRNA product Design e-3 comprising derived and/or modified sequence from HRSV(Memphis-37)__AIY60640.1__F-del_DSCav1_mut8 (opt1)
  source 1..1829: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19662 - RNA, 1829 nt, synthetic construct
  misc_feature 1..1829: note = mRNA product Design e-3 comprising derived and/or modified sequence from HRSV(Memphis-37)__AIY60640.1__F-del_DSCav1_mut8 (opt2)
  source 1..1829: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19663 - RNA, 1829 nt, synthetic construct
  misc_feature 1..1829: note = mRNA product Design e-3 comprising derived and/or modified sequence from HRSV(Memphis-37)__AIY60640.1__F-del_DSCav1_mut8 (opt3)
  source 1..1829: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19664 - RNA, 1829 nt, synthetic construct
  misc_feature 1..1829: note = mRNA product Design e-3 comprising derived and/or modified sequence from HRSV(Memphis-37)__AIY60640.1__F-del_DSCav1_mut8 (opt4)
  source 1..1829: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19665 - RNA, 1829 nt, synthetic construct
  misc_feature 1..1829: note = mRNA product Design e-3 comprising derived and/or modified sequence from HRSV(Memphis-37)__AIY60640.1__F-del_DSCav1_mut8 (opt5)
  source 1..1829: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19666 - RNA, 1829 nt, synthetic construct
  misc_feature 1..1829: note = mRNA product Design e-3 comprising derived and/or modified sequence from HRSV(Memphis-37)__AIY60640.1__F-del_DSCav1_mut8 (opt6)
  source 1..1829: mol_type = other RNA
gggagactttcccattctgtagcagaatttggtgttgcctgtggtcttggtcccgcggagaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19667 - RNA, 1829 nt, synthetic construct
  misc_feature 1..1829: note = mRNA product Design e-3 comprising derived and/or modified sequence from HRSV(Memphis-37)__AIY60640.1__F-del_DSCav1_mut8 (opt11)
  source 1..1829: mol_type = other RNA
gggagactttcccattctgtagcagaatttggtgttgcctgtggtcttggtcccgcggagaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19668 - RNA, 1883 nt, synthetic construct
  misc_feature 1..1883: note = mRNA product Design e-4 comprising derived and/or modified sequence from HRSV(Memphis-37)__AIY60640.1__F-del_DSCav1_mut8 (opt1)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19669 - RNA, 1883 nt, synthetic construct
  misc_feature 1..1883: note = mRNA product Design e-4 comprising derived and/or modified sequence from HRSV(Memphis-37)__AIY60640.1__F-del_DSCav1_mut8 (opt1)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19670 - RNA, 1883 nt, synthetic construct
  misc_feature 1..1883: note = mRNA product Design e-4 comprising derived and/or modified sequence from HRSV(Memphis-37)__AIY60640.1__F-del_DSCav1_mut8 (opt2)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19671 - RNA, 1883 nt, synthetic construct
  misc_feature 1..1883: note = mRNA product Design e-4 comprising derived and/or modified sequence from HRSV(Memphis-37)__AIY60640.1__F-del_DSCav1_mut8 (opt3)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19672 - RNA, 1883 nt, synthetic construct
  misc_feature 1..1883: note = mRNA product Design e-4 comprising derived and/or modified sequence from HRSV(Memphis-37)__AIY60640.1__F-del_DSCav1_mut8 (opt4)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19673 - RNA, 1883 nt, synthetic construct
  misc_feature 1..1883: note = mRNA product Design e-4 comprising derived and/or modified sequence from HRSV(Memphis-37)__AIY60640.1__F-del_DSCav1_mut8 (opt5)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19674 - RNA, 1883 nt, synthetic construct
  misc_feature 1..1883: note = mRNA product Design e-4 comprising derived and/or modified sequence from HRSV(Memphis-37)__AIY60640.1__F-del_DSCav1_mut8 (opt6)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19675 - RNA, 1883 nt, synthetic construct
  misc_feature 1..1883: note = mRNA product Design e-4 comprising derived and/or modified sequence from HRSV(Memphis-37)__AIY60640.1__F-del_DSCav1_mut8 (opt11)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19676 - RNA, 1850 nt, synthetic construct
  misc_feature 1..1850: note = mRNA product Design e-5 comprising derived and/or modified sequence from HRSV(Memphis-37)__AIY60640.1__F-del_DSCav1_mut8 (opt1)
  source 1..1850: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19677 - RNA, 1850 nt, synthetic construct
  misc_feature 1..1850: note = mRNA product Design e-5 comprising derived and/or modified sequence from HRSV(Memphis-37)__AIY60640.1__F-del_DSCav1_mut8 (opt1)
  source 1..1850: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19678 - RNA, 1850 nt, synthetic construct
  misc_feature 1..1850: note = mRNA product Design e-5 comprising derived and/or modified sequence from HRSV(Memphis-37)__AIY60640.1__F-del_DSCav1_mut8 (opt2)
  source 1..1850: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19679 - RNA, 1850 nt, synthetic construct
  misc_feature 1..1850: note = mRNA product Design e-5 comprising derived and/or modified sequence from HRSV(Memphis-37)__AIY60640.1__F-del_DSCav1_mut8 (opt3)
  source 1..1850: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19680 - RNA, 1850 nt, synthetic construct
  misc_feature 1..1850: note = mRNA product Design e-5 comprising derived and/or modified sequence from HRSV(Memphis-37)__AIY60640.1__F-del_DSCav1_mut8 (opt4)
  source 1..1850: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19681 - RNA, 1850 nt, synthetic construct
  misc_feature 1..1850: note = mRNA product Design e-5 comprising derived and/or modified sequence from HRSV(Memphis-37)__AIY60640.1__F-del_DSCav1_mut8 (opt5)
  source 1..1850: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19682 - RNA, 1850 nt, synthetic construct
  misc_feature 1..1850: note = mRNA product Design e-5 comprising derived and/or modified sequence from HRSV(Memphis-37)__AIY60640.1__F-del_DSCav1_mut8 (opt6)
  source 1..1850: mol_type = other RNA
gggagagcggctcggccattttgtcccagtcagtccggaggctgcggctgcagaagtaccgcctgcggagtaactgcaaagaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19683 - RNA, 1850 nt, synthetic construct
  misc_feature 1..1850: note = mRNA product Design e-5 comprising derived and/or modified sequence from HRSV(Memphis-37)__AIY60640.1__F-del_DSCav1_mut8 (opt11)
  source 1..1850: mol_type = other RNA
gggagagcggctcggccattttgtcccagtcagtccggaggctgcggctgcagaagtaccgcctgcggagtaactgcaaagaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19684 - RNA, 1917 nt, synthetic construct
  misc_feature 1..1917: note = mRNA product Design e-6 comprising derived and/or modified sequence from HRSV(Memphis-37)__AIY60640.1__F-del_DSCav1_mut8 (opt1)
  source 1..1917: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19685 - RNA, 1917 nt, synthetic construct
  misc_feature 1..1917: note = mRNA product Design e-6 comprising derived and/or modified sequence from HRSV(Memphis-37)__AIY60640.1__F-del_DSCav1_mut8 (opt1)
  source 1..1917: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19686 - RNA, 1917 nt, synthetic construct
  misc_feature 1..1917: note = mRNA product Design e-6 comprising derived and/or modified sequence from HRSV(Memphis-37)__AIY60640.1__F-del_DSCav1_mut8 (opt2)
  source 1..1917: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19687 - RNA, 1917 nt, synthetic construct
  misc_feature 1..1917: note = mRNA product Design e-6 comprising derived and/or modified sequence from HRSV(Memphis-37)__AIY60640.1__F-del_DSCav1_mut8 (opt3)
  source 1..1917: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19688 - RNA, 1917 nt, synthetic construct
  misc_feature 1..1917: note = mRNA product Design e-6 comprising derived and/or modified sequence from HRSV(Memphis-37)__AIY60640.1__F-del_DSCav1_mut8 (opt4)
  source 1..1917: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19689 - RNA, 1917 nt, synthetic construct
  misc_feature 1..1917: note = mRNA product Design e-6 comprising derived and/or modified sequence from HRSV(Memphis-37)__AIY60640.1__F-del_DSCav1_mut8 (opt5)
  source 1..1917: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19690 - RNA, 1917 nt, synthetic construct
  misc_feature 1..1917: note = mRNA product Design e-6 comprising derived and/or modified sequence from HRSV(Memphis-37)__AIY60640.1__F-del_DSCav1_mut8 (opt6)
  source 1..1917: mol_type = other RNA
gggagagcggctcggccattttgtcccagtcagtccggaggctgcggctgcagaagtaccgcctgcggagtaactgcaaagaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19691 - RNA, 1917 nt, synthetic construct
  misc_feature 1..1917: note = mRNA product Design e-6 comprising derived and/or modified sequence from HRSV(Memphis-37)__AIY60640.1__F-del_DSCav1_mut8 (opt11)
  source 1..1917: mol_type = other RNA
gggagagcggctcggccattttgtcccagtcagtccggaggctgcggctgcagaagtaccgcctgcggagtaactgcaaagaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19692 - RNA, 2133 nt, synthetic construct
  misc_feature 1..2133: note = mRNA product Design f-1 comprising derived and/or modified sequence from HRSV(Memphis-37)__AIY60640.1__F-del_DSCav1_mut8 (opt1)
  source 1..2133: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19693 - RNA, 2133 nt, synthetic construct
  misc_feature 1..2133: note = mRNA product Design f-1 comprising derived and/or modified sequence from HRSV(Memphis-37)__AIY60640.1__F-del_DSCav1_mut8 (opt1)
  source 1..2133: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19694 - RNA, 2133 nt, synthetic construct
  misc_feature 1..2133: note = mRNA product Design f-1 comprising derived and/or modified sequence from HRSV(Memphis-37)__AIY60640.1__F-del_DSCav1_mut8 (opt2)
  source 1..2133: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19695 - RNA, 2133 nt, synthetic construct
  misc_feature 1..2133: note = mRNA product Design f-1 comprising derived and/or modified sequence from HRSV(Memphis-37)__AIY60640.1__F-del_DSCav1_mut8 (opt3)
  source 1..2133: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19696 - RNA, 2133 nt, synthetic construct
  misc_feature 1..2133: note = mRNA product Design f-1 comprising derived and/or modified sequence from HRSV(Memphis-37)__AIY60640.1__F-del_DSCav1_mut8 (opt4)
  source 1..2133: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19697 - RNA, 2133 nt, synthetic construct
  misc_feature 1..2133: note = mRNA product Design f-1 comprising derived and/or modified sequence from HRSV(Memphis-37)__AIY60640.1__F-del_DSCav1_mut8 (opt5)
  source 1..2133: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19698 - RNA, 2133 nt, synthetic construct
  misc_feature 1..2133: note = mRNA product Design f-1 comprising derived and/or modified sequence from HRSV(Memphis-37)__AIY60640.1__F-del_DSCav1_mut8 (opt6)
  source 1..2133: mol_type = other RNA
gggagagcggctcggccattttgtcccagtcagtccggaggctgcggctgcagaagtaccgcctgcggagtaactgcaaagaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19699 - RNA, 2133 nt, synthetic construct
  misc_feature 1..2133: note = mRNA product Design f-1 comprising derived and/or modified sequence from HRSV(Memphis-37)__AIY60640.1__F-del_DSCav1_mut8 (opt11)
  source 1..2133: mol_type = other RNA
gggagagcggctcggccattttgtcccagtcagtccggaggctgcggctgcagaagtaccgcctgcggagtaactgcaaagaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19700 - RNA, 1913 nt, synthetic construct
  misc_feature 1..1913: note = mRNA product Design f-2 comprising derived and/or modified sequence from HRSV(Memphis-37)__AIY60640.1__F-del_DSCav1_mut8 (opt1)
  source 1..1913: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19701 - RNA, 1913 nt, synthetic construct
  misc_feature 1..1913: note = mRNA product Design f-2 comprising derived and/or modified sequence from HRSV(Memphis-37)__AIY60640.1__F-del_DSCav1_mut8 (opt1)
  source 1..1913: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19702 - RNA, 1913 nt, synthetic construct
  misc_feature 1..1913: note = mRNA product Design f-2 comprising derived and/or modified sequence from HRSV(Memphis-37)__AIY60640.1__F-del_DSCav1_mut8 (opt2)
  source 1..1913: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19703 - RNA, 1913 nt, synthetic construct
  misc_feature 1..1913: note = mRNA product Design f-2 comprising derived and/or modified sequence from HRSV(Memphis-37)__AIY60640.1__F-del_DSCav1_mut8 (opt3)
  source 1..1913: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19704 - RNA, 1913 nt, synthetic construct
  misc_feature 1..1913: note = mRNA product Design f-2 comprising derived and/or modified sequence from HRSV(Memphis-37)__AIY60640.1__F-del_DSCav1_mut8 (opt4)
  source 1..1913: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19705 - RNA, 1913 nt, synthetic construct
  misc_feature 1..1913: note = mRNA product Design f-2 comprising derived and/or modified sequence from HRSV(Memphis-37)__AIY60640.1__F-del_DSCav1_mut8 (opt5)
  source 1..1913: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19706 - RNA, 1913 nt, synthetic construct
  misc_feature 1..1913: note = mRNA product Design f-2 comprising derived and/or modified sequence from HRSV(Memphis-37)__AIY60640.1__F-del_DSCav1_mut8 (opt6)
  source 1..1913: mol_type = other RNA
gggagagcggctcggccattttgtcccagtcagtccggaggctgcggctgcagaagtaccgcctgcggagtaactgcaaagaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19707 - RNA, 1913 nt, synthetic construct
  misc_feature 1..1913: note = mRNA product Design f-2 comprising derived and/or modified sequence from HRSV(Memphis-37)__AIY60640.1__F-del_DSCav1_mut8 (opt11)
  source 1..1913: mol_type = other RNA
gggagagcggctcggccattttgtcccagtcagtccggaggctgcggctgcagaagtaccgcctgcggagtaactgcaaagaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19708 - RNA, 1904 nt, synthetic construct
  misc_feature 1..1904: note = mRNA product Design f-3 comprising derived and/or modified sequence from HRSV(Memphis-37)__AIY60640.1__F-del_DSCav1_mut8 (opt1)
  source 1..1904: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19709 - RNA, 1904 nt, synthetic construct
  misc_feature 1..1904: note = mRNA product Design f-3 comprising derived and/or modified sequence from HRSV(Memphis-37)__AIY60640.1__F-del_DSCav1_mut8 (opt1)
  source 1..1904: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19710 - RNA, 1904 nt, synthetic construct
  misc_feature 1..1904: note = mRNA product Design f-3 comprising derived and/or modified sequence from HRSV(Memphis-37)__AIY60640.1__F-del_DSCav1_mut8 (opt2)
  source 1..1904: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19711 - RNA, 1904 nt, synthetic construct
  misc_feature 1..1904: note = mRNA product Design f-3 comprising derived and/or modified sequence from HRSV(Memphis-37)__AIY60640.1__F-del_DSCav1_mut8 (opt3)
  source 1..1904: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19712 - RNA, 1904 nt, synthetic construct
  misc_feature 1..1904: note = mRNA product Design f-3 comprising derived and/or modified sequence from HRSV(Memphis-37)__AIY60640.1__F-del_DSCav1_mut8 (opt4)
  source 1..1904: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19713 - RNA, 1904 nt, synthetic construct
  misc_feature 1..1904: note = mRNA product Design f-3 comprising derived and/or modified sequence from HRSV(Memphis-37)__AIY60640.1__F-del_DSCav1_mut8 (opt5)
  source 1..1904: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19714 - RNA, 1904 nt, synthetic construct
  misc_feature 1..1904: note = mRNA product Design f-3 comprising derived and/or modified sequence from HRSV(Memphis-37)__AIY60640.1__F-del_DSCav1_mut8 (opt6)
  source 1..1904: mol_type = other RNA
gggagagtcccgcagtcggcgtccagcggctctgcttgttcgtgtgtgtgtcgttgcaggccttattcaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19715 - RNA, 1904 nt, synthetic construct
  misc_feature 1..1904: note = mRNA product Design f-3 comprising derived and/or modified sequence from HRSV(Memphis-37)__AIY60640.1__F-del_DSCav1_mut8 (opt11)
  source 1..1904: mol_type = other RNA
gggagagtcccgcagtcggcgtccagcggctctgcttgttcgtgtgtgtgtcgttgcaggccttattcaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19716 - RNA, 2120 nt, synthetic construct
  misc_feature 1..2120: note = mRNA product Design f-4 comprising derived and/or modified sequence from HRSV(Memphis-37)__AIY60640.1__F-del_DSCav1_mut8 (opt1)
  source 1..2120: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19717 - RNA, 2120 nt, synthetic construct
  misc_feature 1..2120: note = mRNA product Design f-4 comprising derived and/or modified sequence from HRSV(Memphis-37)__AIY60640.1__F-del_DSCav1_mut8 (opt1)
  source 1..2120: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19718 - RNA, 2120 nt, synthetic construct
  misc_feature 1..2120: note = mRNA product Design f-4 comprising derived and/or modified sequence from HRSV(Memphis-37)__AIY60640.1__F-del_DSCav1_mut8 (opt2)
  source 1..2120: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19719 - RNA, 2120 nt, synthetic construct
  misc_feature 1..2120: note = mRNA product Design f-4 comprising derived and/or modified sequence from HRSV(Memphis-37)__AIY60640.1__F-del_DSCav1_mut8 (opt3)
  source 1..2120: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19720 - RNA, 2120 nt, synthetic construct
  misc_feature 1..2120: note = mRNA product Design f-4 comprising derived and/or modified sequence from HRSV(Memphis-37)__AIY60640.1__F-del_DSCav1_mut8 (opt4)
  source 1..2120: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19721 - RNA, 2120 nt, synthetic construct
  misc_feature 1..2120: note = mRNA product Design f-4 comprising derived and/or modified sequence from HRSV(Memphis-37)__AIY60640.1__F-del_DSCav1_mut8 (opt5)
  source 1..2120: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19722 - RNA, 2120 nt, synthetic construct
  misc_feature 1..2120: note = mRNA product Design f-4 comprising derived and/or modified sequence from HRSV(Memphis-37)__AIY60640.1__F-del_DSCav1_mut8 (opt6)
  source 1..2120: mol_type = other RNA
gggagagtcccgcagtcggcgtccagcggctctgcttgttcgtgtgtgtgtcgttgcaggccttattcaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19723 - RNA, 2120 nt, synthetic construct
  misc_feature 1..2120: note = mRNA product Design f-4 comprising derived and/or modified sequence from HRSV(Memphis-37)__AIY60640.1__F-del_DSCav1_mut8 (opt11)
  source 1..2120: mol_type = other RNA
gggagagtcccgcagtcggcgtccagcggctctgcttgttcgtgtgtgtgtcgttgcaggccttattcaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19724 - RNA, 1896 nt, synthetic construct
  misc_feature 1..1896: note = mRNA product Design f-5 comprising derived and/or modified sequence from HRSV(Memphis-37)__AIY60640.1__F-del_DSCav1_mut8 (opt1)
  source 1..1896: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19725 - RNA, 1896 nt, synthetic construct
  misc_feature 1..1896: note = mRNA product Design f-5 comprising derived and/or modified sequence from HRSV(Memphis-37)__AIY60640.1__F-del_DSCav1_mut8 (opt1)
  source 1..1896: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19726 - RNA, 1896 nt, synthetic construct
  misc_feature 1..1896: note = mRNA product Design f-5 comprising derived and/or modified sequence from HRSV(Memphis-37)__AIY60640.1__F-del_DSCav1_mut8 (opt2)
  source 1..1896: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19727 - RNA, 1896 nt, synthetic construct
  misc_feature 1..1896: note = mRNA product Design f-5 comprising derived and/or modified sequence from HRSV(Memphis-37)__AIY60640.1__F-del_DSCav1_mut8 (opt3)
  source 1..1896: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19728 - RNA, 1896 nt, synthetic construct
  misc_feature 1..1896: note = mRNA product Design f-5 comprising derived and/or modified sequence from HRSV(Memphis-37)__AIY60640.1__F-del_DSCav1_mut8 (opt4)
  source 1..1896: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19729 - RNA, 1896 nt, synthetic construct
  misc_feature 1..1896: note = mRNA product Design f-5 comprising derived and/or modified sequence from HRSV(Memphis-37)__AIY60640.1__F-del_DSCav1_mut8 (opt5)
  source 1..1896: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19730 - RNA, 1896 nt, synthetic construct
  misc_feature 1..1896: note = mRNA product Design f-5 comprising derived and/or modified sequence from HRSV(Memphis-37)__AIY60640.1__F-del_DSCav1_mut8 (opt6)
  source 1..1896: mol_type = other RNA
gggagactttcccattctgtagcagaatttggtgttgcctgtggtcttggtcccgcggagaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19731 - RNA, 1896 nt, synthetic construct
  misc_feature 1..1896: note = mRNA product Design f-5 comprising derived and/or modified sequence from HRSV(Memphis-37)__AIY60640.1__F-del_DSCav1_mut8 (opt11)
  source 1..1896: mol_type = other RNA
gggagactttcccattctgtagcagaatttggtgttgcctgtggtcttggtcccgcggagaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19732 - RNA, 1892 nt, synthetic construct
  misc_feature 1..1892: note = mRNA product Design g-1 comprising derived and/or modified sequence from HRSV(Memphis-37)__AIY60640.1__F-del_DSCav1_mut8 (opt1)
  source 1..1892: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19733 - RNA, 1892 nt, synthetic construct
  misc_feature 1..1892: note = mRNA product Design g-1 comprising derived and/or modified sequence from HRSV(Memphis-37)__AIY60640.1__F-del_DSCav1_mut8 (opt1)
  source 1..1892: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19734 - RNA, 1892 nt, synthetic construct
  misc_feature 1..1892: note = mRNA product Design g-1 comprising derived and/or modified sequence from HRSV(Memphis-37)__AIY60640.1__F-del_DSCav1_mut8 (opt2)
  source 1..1892: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19735 - RNA, 1892 nt, synthetic construct
  misc_feature 1..1892: note = mRNA product Design g-1 comprising derived and/or modified sequence from HRSV(Memphis-37)__AIY60640.1__F-del_DSCav1_mut8 (opt3)
  source 1..1892: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19736 - RNA, 1892 nt, synthetic construct
  misc_feature 1..1892: note = mRNA product Design g-1 comprising derived and/or modified sequence from HRSV(Memphis-37)__AIY60640.1__F-del_DSCav1_mut8 (opt4)
  source 1..1892: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19737 - RNA, 1892 nt, synthetic construct
  misc_feature 1..1892: note = mRNA product Design g-1 comprising derived and/or modified sequence from HRSV(Memphis-37)__AIY60640.1__F-del_DSCav1_mut8 (opt5)
  source 1..1892: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19738 - RNA, 1892 nt, synthetic construct
  misc_feature 1..1892: note = mRNA product Design g-1 comprising derived and/or modified sequence from HRSV(Memphis-37)__AIY60640.1__F-del_DSCav1_mut8 (opt6)
  source 1..1892: mol_type = other RNA
gggagactttcccattctgtagcagaatttggtgttgcctgtggtcttggtcccgcggagaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19739 - RNA, 1892 nt, synthetic construct
  misc_feature 1..1892: note = mRNA product Design g-1 comprising derived and/or modified sequence from HRSV(Memphis-37)__AIY60640.1__F-del_DSCav1_mut8 (opt11)
  source 1..1892: mol_type = other RNA
gggagactttcccattctgtagcagaatttggtgttgcctgtggtcttggtcccgcggagaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19740 - RNA, 1907 nt, synthetic construct
  misc_feature 1..1907: note = mRNA product Design g-2 comprising derived and/or modified sequence from HRSV(Memphis-37)__AIY60640.1__F-del_DSCav1_mut8 (opt1)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19741 - RNA, 1907 nt, synthetic construct
  misc_feature 1..1907: note = mRNA product Design g-2 comprising derived and/or modified sequence from HRSV(Memphis-37)__AIY60640.1__F-del_DSCav1_mut8 (opt1)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19742 - RNA, 1907 nt, synthetic construct
  misc_feature 1..1907: note = mRNA product Design g-2 comprising derived and/or modified sequence from HRSV(Memphis-37)__AIY60640.1__F-del_DSCav1_mut8 (opt2)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19743 - RNA, 1907 nt, synthetic construct
  misc_feature 1..1907: note = mRNA product Design g-2 comprising derived and/or modified sequence from HRSV(Memphis-37)__AIY60640.1__F-del_DSCav1_mut8 (opt3)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19744 - RNA, 1907 nt, synthetic construct
  misc_feature 1..1907: note = mRNA product Design g-2 comprising derived and/or modified sequence from HRSV(Memphis-37)__AIY60640.1__F-del_DSCav1_mut8 (opt4)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19745 - RNA, 1907 nt, synthetic construct
  misc_feature 1..1907: note = mRNA product Design g-2 comprising derived and/or modified sequence from HRSV(Memphis-37)__AIY60640.1__F-del_DSCav1_mut8 (opt5)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19746 - RNA, 1907 nt, synthetic construct
  misc_feature 1..1907: note = mRNA product Design g-2 comprising derived and/or modified sequence from HRSV(Memphis-37)__AIY60640.1__F-del_DSCav1_mut8 (opt6)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19747 - RNA, 1907 nt, synthetic construct
  misc_feature 1..1907: note = mRNA product Design g-2 comprising derived and/or modified sequence from HRSV(Memphis-37)__AIY60640.1__F-del_DSCav1_mut8 (opt11)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19748 - RNA, 2139 nt, synthetic construct
  misc_feature 1..2139: note = mRNA product Design g-3 comprising derived and/or modified sequence from HRSV(Memphis-37)__AIY60640.1__F-del_DSCav1_mut8 (opt1)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19749 - RNA, 2139 nt, synthetic construct
  misc_feature 1..2139: note = mRNA product Design g-3 comprising derived and/or modified sequence from HRSV(Memphis-37)__AIY60640.1__F-del_DSCav1_mut8 (opt1)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19750 - RNA, 2139 nt, synthetic construct
  misc_feature 1..2139: note = mRNA product Design g-3 comprising derived and/or modified sequence from HRSV(Memphis-37)__AIY60640.1__F-del_DSCav1_mut8 (opt2)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19751 - RNA, 2139 nt, synthetic construct
  misc_feature 1..2139: note = mRNA product Design g-3 comprising derived and/or modified sequence from HRSV(Memphis-37)__AIY60640.1__F-del_DSCav1_mut8 (opt3)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19752 - RNA, 2139 nt, synthetic construct
  misc_feature 1..2139: note = mRNA product Design g-3 comprising derived and/or modified sequence from HRSV(Memphis-37)__AIY60640.1__F-del_DSCav1_mut8 (opt4)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19753 - RNA, 2139 nt, synthetic construct
  misc_feature 1..2139: note = mRNA product Design g-3 comprising derived and/or modified sequence from HRSV(Memphis-37)__AIY60640.1__F-del_DSCav1_mut8 (opt5)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19754 - RNA, 2139 nt, synthetic construct
  misc_feature 1..2139: note = mRNA product Design g-3 comprising derived and/or modified sequence from HRSV(Memphis-37)__AIY60640.1__F-del_DSCav1_mut8 (opt6)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19755 - RNA, 2139 nt, synthetic construct
  misc_feature 1..2139: note = mRNA product Design g-3 comprising derived and/or modified sequence from HRSV(Memphis-37)__AIY60640.1__F-del_DSCav1_mut8 (opt11)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19756 - RNA, 1934 nt, synthetic construct
  misc_feature 1..1934: note = mRNA product Design g-4 comprising derived and/or modified sequence from HRSV(Memphis-37)__AIY60640.1__F-del_DSCav1_mut8 (opt1)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19757 - RNA, 1934 nt, synthetic construct
  misc_feature 1..1934: note = mRNA product Design g-4 comprising derived and/or modified sequence from HRSV(Memphis-37)__AIY60640.1__F-del_DSCav1_mut8 (opt1)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19758 - RNA, 1934 nt, synthetic construct
  misc_feature 1..1934: note = mRNA product Design g-4 comprising derived and/or modified sequence from HRSV(Memphis-37)__AIY60640.1__F-del_DSCav1_mut8 (opt2)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19759 - RNA, 1934 nt, synthetic construct
  misc_feature 1..1934: note = mRNA product Design g-4 comprising derived and/or modified sequence from HRSV(Memphis-37)__AIY60640.1__F-del_DSCav1_mut8 (opt3)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19760 - RNA, 1934 nt, synthetic construct
  misc_feature 1..1934: note = mRNA product Design g-4 comprising derived and/or modified sequence from HRSV(Memphis-37)__AIY60640.1__F-del_DSCav1_mut8 (opt4)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19761 - RNA, 1934 nt, synthetic construct
  misc_feature 1..1934: note = mRNA product Design g-4 comprising derived and/or modified sequence from HRSV(Memphis-37)__AIY60640.1__F-del_DSCav1_mut8 (opt5)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19762 - RNA, 1934 nt, synthetic construct
  misc_feature 1..1934: note = mRNA product Design g-4 comprising derived and/or modified sequence from HRSV(Memphis-37)__AIY60640.1__F-del_DSCav1_mut8 (opt6)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19763 - RNA, 1934 nt, synthetic construct
  misc_feature 1..1934: note = mRNA product Design g-4 comprising derived and/or modified sequence from HRSV(Memphis-37)__AIY60640.1__F-del_DSCav1_mut8 (opt11)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19764 - RNA, 1910 nt, synthetic construct
  misc_feature 1..1910: note = mRNA product Design g-5 comprising derived and/or modified sequence from HRSV(Memphis-37)__AIY60640.1__F-del_DSCav1_mut8 (opt1)
  source 1..1910: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19765 - RNA, 1910 nt, synthetic construct
  misc_feature 1..1910: note = mRNA product Design g-5 comprising derived and/or modified sequence from HRSV(Memphis-37)__AIY60640.1__F-del_DSCav1_mut8 (opt1)
  source 1..1910: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19766 - RNA, 1910 nt, synthetic construct
  misc_feature 1..1910: note = mRNA product Design g-5 comprising derived and/or modified sequence from HRSV(Memphis-37)__AIY60640.1__F-del_DSCav1_mut8 (opt2)
  source 1..1910: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19767 - RNA, 1910 nt, synthetic construct
  misc_feature 1..1910: note = mRNA product Design g-5 comprising derived and/or modified sequence from HRSV(Memphis-37)__AIY60640.1__F-del_DSCav1_mut8 (opt3)
  source 1..1910: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19768 - RNA, 1910 nt, synthetic construct
  misc_feature 1..1910: note = mRNA product Design g-5 comprising derived and/or modified sequence from HRSV(Memphis-37)__AIY60640.1__F-del_DSCav1_mut8 (opt4)
  source 1..1910: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19769 - RNA, 1910 nt, synthetic construct
  misc_feature 1..1910: note = mRNA product Design g-5 comprising derived and/or modified sequence from HRSV(Memphis-37)__AIY60640.1__F-del_DSCav1_mut8 (opt5)
  source 1..1910: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19770 - RNA, 1910 nt, synthetic construct
  misc_feature 1..1910: note = mRNA product Design g-5 comprising derived and/or modified sequence from HRSV(Memphis-37)__AIY60640.1__F-del_DSCav1_mut8 (opt6)
  source 1..1910: mol_type = other RNA
gggagacccgtgacccggaagttgtacggctacgcgactttccctcccacaaaccctcgcgcccttcctttcctacttgggcccggcagaaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19771 - RNA, 1910 nt, synthetic construct
  misc_feature 1..1910: note = mRNA product Design g-5 comprising derived and/or modified sequence from HRSV(Memphis-37)__AIY60640.1__F-del_DSCav1_mut8 (opt11)
  source 1..1910: mol_type = other RNA
gggagacccgtgacccggaagttgtacggctacgcgactttccctcccacaaaccctcgcgcccttcctttcctacttgggcccggcagaaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19772 - RNA, 1926 nt, synthetic construct
  misc_feature 1..1926: note = mRNA product Design h-1 comprising derived and/or modified sequence from HRSV(Memphis-37)__AIY60640.1__F-del_DSCav1_mut8 (opt1)
  source 1..1926: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19773 - RNA, 1926 nt, synthetic construct
  misc_feature 1..1926: note = mRNA product Design h-1 comprising derived and/or modified sequence from HRSV(Memphis-37)__AIY60640.1__F-del_DSCav1_mut8 (opt1)
  source 1..1926: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19774 - RNA, 1926 nt, synthetic construct
  misc_feature 1..1926: note = mRNA product Design h-1 comprising derived and/or modified sequence from HRSV(Memphis-37)__AIY60640.1__F-del_DSCav1_mut8 (opt2)
  source 1..1926: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19775 - RNA, 1926 nt, synthetic construct
  misc_feature 1..1926: note = mRNA product Design h-1 comprising derived and/or modified sequence from HRSV(Memphis-37)__AIY60640.1__F-del_DSCav1_mut8 (opt3)
  source 1..1926: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19776 - RNA, 1926 nt, synthetic construct
  misc_feature 1..1926: note = mRNA product Design h-1 comprising derived and/or modified sequence from HRSV(Memphis-37)__AIY60640.1__F-del_DSCav1_mut8 (opt4)
  source 1..1926: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19777 - RNA, 1926 nt, synthetic construct
  misc_feature 1..1926: note = mRNA product Design h-1 comprising derived and/or modified sequence from HRSV(Memphis-37)__AIY60640.1__F-del_DSCav1_mut8 (opt5)
  source 1..1926: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19778 - RNA, 1926 nt, synthetic construct
  misc_feature 1..1926: note = mRNA product Design h-1 comprising derived and/or modified sequence from HRSV(Memphis-37)__AIY60640.1__F-del_DSCav1_mut8 (opt6)
  source 1..1926: mol_type = other RNA
gggagacccgtgacccggaagttgtacggctacgcgactttccctcccacaaaccctcgcgcccttcctttcctacttgggcccggcagaaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19779 - RNA, 1926 nt, synthetic construct
  misc_feature 1..1926: note = mRNA product Design h-1 comprising derived and/or modified sequence from HRSV(Memphis-37)__AIY60640.1__F-del_DSCav1_mut8 (opt11)
  source 1..1926: mol_type = other RNA
gggagacccgtgacccggaagttgtacggctacgcgactttccctcccacaaaccctcgcgcccttcctttcctacttgggcccggcagaaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19780 - RNA, 2142 nt, synthetic construct
  misc_feature 1..2142: note = mRNA product Design h-2 comprising derived and/or modified sequence from HRSV(Memphis-37)__AIY60640.1__F-del_DSCav1_mut8 (opt1)
  source 1..2142: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19781 - RNA, 2142 nt, synthetic construct
  misc_feature 1..2142: note = mRNA product Design h-2 comprising derived and/or modified sequence from HRSV(Memphis-37)__AIY60640.1__F-del_DSCav1_mut8 (opt1)
  source 1..2142: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19782 - RNA, 2142 nt, synthetic construct
  misc_feature 1..2142: note = mRNA product Design h-2 comprising derived and/or modified sequence from HRSV(Memphis-37)__AIY60640.1__F-del_DSCav1_mut8 (opt2)
  source 1..2142: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19783 - RNA, 2142 nt, synthetic construct
  misc_feature 1..2142: note = mRNA product Design h-2 comprising derived and/or modified sequence from HRSV(Memphis-37)__AIY60640.1__F-del_DSCav1_mut8 (opt3)
  source 1..2142: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19784 - RNA, 2142 nt, synthetic construct
  misc_feature 1..2142: note = mRNA product Design h-2 comprising derived and/or modified sequence from HRSV(Memphis-37)__AIY60640.1__F-del_DSCav1_mut8 (opt4)
  source 1..2142: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19785 - RNA, 2142 nt, synthetic construct
  misc_feature 1..2142: note = mRNA product Design h-2 comprising derived and/or modified sequence from HRSV(Memphis-37)__AIY60640.1__F-del_DSCav1_mut8 (opt5)
  source 1..2142: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19786 - RNA, 2142 nt, synthetic construct
  misc_feature 1..2142: note = mRNA product Design h-2 comprising derived and/or modified sequence from HRSV(Memphis-37)__AIY60640.1__F-del_DSCav1_mut8 (opt6)
  source 1..2142: mol_type = other RNA
gggagacccgtgacccggaagttgtacggctacgcgactttccctcccacaaaccctcgcgcccttcctttcctacttgggcccggcagaaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19787 - RNA, 2142 nt, synthetic construct
  misc_feature 1..2142: note = mRNA product Design h-2 comprising derived and/or modified sequence from HRSV(Memphis-37)__AIY60640.1__F-del_DSCav1_mut8 (opt11)
  source 1..2142: mol_type = other RNA
gggagacccgtgacccggaagttgtacggctacgcgactttccctcccacaaaccctcgcgcccttcctttcctacttgggcccggcagaaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19788 - RNA, 1922 nt, synthetic construct
  misc_feature 1..1922: note = mRNA product Design h-3 comprising derived and/or modified sequence from HRSV(Memphis-37)__AIY60640.1__F-del_DSCav1_mut8 (opt1)
  source 1..1922: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19789 - RNA, 1922 nt, synthetic construct
  misc_feature 1..1922: note = mRNA product Design h-3 comprising derived and/or modified sequence from HRSV(Memphis-37)__AIY60640.1__F-del_DSCav1_mut8 (opt1)
  source 1..1922: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19790 - RNA, 1922 nt, synthetic construct
  misc_feature 1..1922: note = mRNA product Design h-3 comprising derived and/or modified sequence from HRSV(Memphis-37)__AIY60640.1__F-del_DSCav1_mut8 (opt2)
  source 1..1922: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19791 - RNA, 1922 nt, synthetic construct
  misc_feature 1..1922: note = mRNA product Design h-3 comprising derived and/or modified sequence from HRSV(Memphis-37)__AIY60640.1__F-del_DSCav1_mut8 (opt3)
  source 1..1922: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19792 - RNA, 1922 nt, synthetic construct
  misc_feature 1..1922: note = mRNA product Design h-3 comprising derived and/or modified sequence from HRSV(Memphis-37)__AIY60640.1__F-del_DSCav1_mut8 (opt4)
  source 1..1922: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19793 - RNA, 1922 nt, synthetic construct
  misc_feature 1..1922: note = mRNA product Design h-3 comprising derived and/or modified sequence from HRSV(Memphis-37)__AIY60640.1__F-del_DSCav1_mut8 (opt5)
  source 1..1922: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19794 - RNA, 1922 nt, synthetic construct
  misc_feature 1..1922: note = mRNA product Design h-3 comprising derived and/or modified sequence from HRSV(Memphis-37)__AIY60640.1__F-del_DSCav1_mut8 (opt6)
  source 1..1922: mol_type = other RNA
gggagacccgtgacccggaagttgtacggctacgcgactttccctcccacaaaccctcgcgcccttcctttcctacttgggcccggcagaaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19795 - RNA, 1922 nt, synthetic construct
  misc_feature 1..1922: note = mRNA product Design h-3 comprising derived and/or modified sequence from HRSV(Memphis-37)__AIY60640.1__F-del_DSCav1_mut8 (opt11)
  source 1..1922: mol_type = other RNA
gggagacccgtgacccggaagttgtacggctacgcgactttccctcccacaaaccctcgcgcccttcctttcctacttgggcccggcagaaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19796 - RNA, 1985 nt, synthetic construct
  misc_feature 1..1985: note = mRNA product Design h-4 comprising derived and/or modified sequence from HRSV(Memphis-37)__AIY60640.1__F-del_DSCav1_mut8 (opt1)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19797 - RNA, 1985 nt, synthetic construct
  misc_feature 1..1985: note = mRNA product Design h-4 comprising derived and/or modified sequence from HRSV(Memphis-37)__AIY60640.1__F-del_DSCav1_mut8 (opt1)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19798 - RNA, 1985 nt, synthetic construct
  misc_feature 1..1985: note = mRNA product Design h-4 comprising derived and/or modified sequence from HRSV(Memphis-37)__AIY60640.1__F-del_DSCav1_mut8 (opt2)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19799 - RNA, 1985 nt, synthetic construct
  misc_feature 1..1985: note = mRNA product Design h-4 comprising derived and/or modified sequence from HRSV(Memphis-37)__AIY60640.1__F-del_DSCav1_mut8 (opt3)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19800 - RNA, 1985 nt, synthetic construct
  misc_feature 1..1985: note = mRNA product Design h-4 comprising derived and/or modified sequence from HRSV(Memphis-37)__AIY60640.1__F-del_DSCav1_mut8 (opt4)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19801 - RNA, 1985 nt, synthetic construct
  misc_feature 1..1985: note = mRNA product Design h-4 comprising derived and/or modified sequence from HRSV(Memphis-37)__AIY60640.1__F-del_DSCav1_mut8 (opt5)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19802 - RNA, 1985 nt, synthetic construct
  misc_feature 1..1985: note = mRNA product Design h-4 comprising derived and/or modified sequence from HRSV(Memphis-37)__AIY60640.1__F-del_DSCav1_mut8 (opt6)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19803 - RNA, 1985 nt, synthetic construct
  misc_feature 1..1985: note = mRNA product Design h-4 comprising derived and/or modified sequence from HRSV(Memphis-37)__AIY60640.1__F-del_DSCav1_mut8 (opt11)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19804 - RNA, 2001 nt, synthetic construct
  misc_feature 1..2001: note = mRNA product Design h-5 comprising derived and/or modified sequence from HRSV(Memphis-37)__AIY60640.1__F-del_DSCav1_mut8 (opt1)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19805 - RNA, 2001 nt, synthetic construct
  misc_feature 1..2001: note = mRNA product Design h-5 comprising derived and/or modified sequence from HRSV(Memphis-37)__AIY60640.1__F-del_DSCav1_mut8 (opt1)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19806 - RNA, 2001 nt, synthetic construct
  misc_feature 1..2001: note = mRNA product Design h-5 comprising derived and/or modified sequence from HRSV(Memphis-37)__AIY60640.1__F-del_DSCav1_mut8 (opt2)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19807 - RNA, 2001 nt, synthetic construct
  misc_feature 1..2001: note = mRNA product Design h-5 comprising derived and/or modified sequence from HRSV(Memphis-37)__AIY60640.1__F-del_DSCav1_mut8 (opt3)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19808 - RNA, 2001 nt, synthetic construct
  misc_feature 1..2001: note = mRNA product Design h-5 comprising derived and/or modified sequence from HRSV(Memphis-37)__AIY60640.1__F-del_DSCav1_mut8 (opt4)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19809 - RNA, 2001 nt, synthetic construct
  misc_feature 1..2001: note = mRNA product Design h-5 comprising derived and/or modified sequence from HRSV(Memphis-37)__AIY60640.1__F-del_DSCav1_mut8 (opt5)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19810 - RNA, 2001 nt, synthetic construct
  misc_feature 1..2001: note = mRNA product Design h-5 comprising derived and/or modified sequence from HRSV(Memphis-37)__AIY60640.1__F-del_DSCav1_mut8 (opt6)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19811 - RNA, 2001 nt, synthetic construct
  misc_feature 1..2001: note = mRNA product Design h-5 comprising derived and/or modified sequence from HRSV(Memphis-37)__AIY60640.1__F-del_DSCav1_mut8 (opt11)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19812 - RNA, 1934 nt, synthetic construct
  misc_feature 1..1934: note = mRNA product Design i-1 comprising derived and/or modified sequence from HRSV(Memphis-37)__AIY60640.1__F-del_DSCav1_mut8 (opt1)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19813 - RNA, 1934 nt, synthetic construct
  misc_feature 1..1934: note = mRNA product Design i-1 comprising derived and/or modified sequence from HRSV(Memphis-37)__AIY60640.1__F-del_DSCav1_mut8 (opt1)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19814 - RNA, 1934 nt, synthetic construct
  misc_feature 1..1934: note = mRNA product Design i-1 comprising derived and/or modified sequence from HRSV(Memphis-37)__AIY60640.1__F-del_DSCav1_mut8 (opt2)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19815 - RNA, 1934 nt, synthetic construct
  misc_feature 1..1934: note = mRNA product Design i-1 comprising derived and/or modified sequence from HRSV(Memphis-37)__AIY60640.1__F-del_DSCav1_mut8 (opt3)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19816 - RNA, 1934 nt, synthetic construct
  misc_feature 1..1934: note = mRNA product Design i-1 comprising derived and/or modified sequence from HRSV(Memphis-37)__AIY60640.1__F-del_DSCav1_mut8 (opt4)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19817 - RNA, 1934 nt, synthetic construct
  misc_feature 1..1934: note = mRNA product Design i-1 comprising derived and/or modified sequence from HRSV(Memphis-37)__AIY60640.1__F-del_DSCav1_mut8 (opt5)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19818 - RNA, 1934 nt, synthetic construct
  misc_feature 1..1934: note = mRNA product Design i-1 comprising derived and/or modified sequence from HRSV(Memphis-37)__AIY60640.1__F-del_DSCav1_mut8 (opt6)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19819 - RNA, 1934 nt, synthetic construct
  misc_feature 1..1934: note = mRNA product Design i-1 comprising derived and/or modified sequence from HRSV(Memphis-37)__AIY60640.1__F-del_DSCav1_mut8 (opt11)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19820 - RNA, 1934 nt, synthetic construct
  misc_feature 1..1934: note = mRNA product Design i-2 comprising derived and/or modified sequence from HRSV(Memphis-37)__AIY60640.1__F-del_DSCav1_mut8 (opt1)
  source 1..1934: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19821 - RNA, 1934 nt, synthetic construct
  misc_feature 1..1934: note = mRNA product Design i-2 comprising derived and/or modified sequence from HRSV(Memphis-37)__AIY60640.1__F-del_DSCav1_mut8 (opt1)
  source 1..1934: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19822 - RNA, 1934 nt, synthetic construct
  misc_feature 1..1934: note = mRNA product Design i-2 comprising derived and/or modified sequence from HRSV(Memphis-37)__AIY60640.1__F-del_DSCav1_mut8 (opt2)
  source 1..1934: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19823 - RNA, 1934 nt, synthetic construct
  misc_feature 1..1934: note = mRNA product Design i-2 comprising derived and/or modified sequence from HRSV(Memphis-37)__AIY60640.1__F-del_DSCav1_mut8 (opt3)
  source 1..1934: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19824 - RNA, 1934 nt, synthetic construct
  misc_feature 1..1934: note = mRNA product Design i-2 comprising derived and/or modified sequence from HRSV(Memphis-37)__AIY60640.1__F-del_DSCav1_mut8 (opt4)
  source 1..1934: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19825 - RNA, 1934 nt, synthetic construct
  misc_feature 1..1934: note = mRNA product Design i-2 comprising derived and/or modified sequence from HRSV(Memphis-37)__AIY60640.1__F-del_DSCav1_mut8 (opt5)
  source 1..1934: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19826 - RNA, 1934 nt, synthetic construct
  misc_feature 1..1934: note = mRNA product Design i-2 comprising derived and/or modified sequence from HRSV(Memphis-37)__AIY60640.1__F-del_DSCav1_mut8 (opt6)
  source 1..1934: mol_type = other RNA
gggagaggcgctgcctacggaggtggcagccatctccttctcggcatcaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19827 - RNA, 1934 nt, synthetic construct
  misc_feature 1..1934: note = mRNA product Design i-2 comprising derived and/or modified sequence from HRSV(Memphis-37)__AIY60640.1__F-del_DSCav1_mut8 (opt11)
  source 1..1934: mol_type = other RNA
gggagaggcgctgcctacggaggtggcagccatctccttctcggcatcaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19828 - RNA, 1930 nt, synthetic construct
  misc_feature 1..1930: note = mRNA product Design i-2 comprising derived and/or modified sequence from HRSV(Memphis-37)__AIY60640.1__F-del_DSCav1_mut8 (opt1)
  source 1..1930: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19829 - RNA, 1930 nt, synthetic construct
  misc_feature 1..1930: note = mRNA product Design i-2 comprising derived and/or modified sequence from HRSV(Memphis-37)__AIY60640.1__F-del_DSCav1_mut8 (opt1)
  source 1..1930: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19830 - RNA, 1930 nt, synthetic construct
  misc_feature 1..1930: note = mRNA product Design i-2 comprising derived and/or modified sequence from HRSV(Memphis-37)__AIY60640.1__F-del_DSCav1_mut8 (opt2)
  source 1..1930: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19831 - RNA, 1930 nt, synthetic construct
  misc_feature 1..1930: note = mRNA product Design i-2 comprising derived and/or modified sequence from HRSV(Memphis-37)__AIY60640.1__F-del_DSCav1_mut8 (opt3)
  source 1..1930: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19832 - RNA, 1930 nt, synthetic construct
  misc_feature 1..1930: note = mRNA product Design i-2 comprising derived and/or modified sequence from HRSV(Memphis-37)__AIY60640.1__F-del_DSCav1_mut8 (opt4)
  source 1..1930: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19833 - RNA, 1930 nt, synthetic construct
  misc_feature 1..1930: note = mRNA product Design i-2 comprising derived and/or modified sequence from HRSV(Memphis-37)__AIY60640.1__F-del_DSCav1_mut8 (opt5)
  source 1..1930: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19834 - RNA, 1930 nt, synthetic construct
  misc_feature 1..1930: note = mRNA product Design i-2 comprising derived and/or modified sequence from HRSV(Memphis-37)__AIY60640.1__F-del_DSCav1_mut8 (opt6)
  source 1..1930: mol_type = other RNA
ggggcgctgcctacggaggtggcagccatctccttctcggcatcaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19835 - RNA, 1930 nt, synthetic construct
  misc_feature 1..1930: note = mRNA product Design i-2 comprising derived and/or modified sequence from HRSV(Memphis-37)__AIY60640.1__F-del_DSCav1_mut8 (opt11)
  source 1..1930: mol_type = other RNA
ggggcgctgcctacggaggtggcagccatctccttctcggcatcaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19836 - RNA, 1765 nt, synthetic construct
  misc_feature 1..1765: note = mRNA product Design i-3 comprising derived and/or modified sequence from HRSV(Memphis-37)__AIY60640.1__F-del_DSCav1_mut8 (opt1)
  source 1..1765: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19837 - RNA, 1765 nt, synthetic construct
  misc_feature 1..1765: note = mRNA product Design i-3 comprising derived and/or modified sequence from HRSV(Memphis-37)__AIY60640.1__F-del_DSCav1_mut8 (opt1)
  source 1..1765: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19838 - RNA, 1765 nt, synthetic construct
  misc_feature 1..1765: note = mRNA product Design i-3 comprising derived and/or modified sequence from HRSV(Memphis-37)__AIY60640.1__F-del_DSCav1_mut8 (opt2)
  source 1..1765: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19839 - RNA, 1765 nt, synthetic construct
  misc_feature 1..1765: note = mRNA product Design i-3 comprising derived and/or modified sequence from HRSV(Memphis-37)__AIY60640.1__F-del_DSCav1_mut8 (opt3)
  source 1..1765: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19840 - RNA, 1765 nt, synthetic construct
  misc_feature 1..1765: note = mRNA product Design i-3 comprising derived and/or modified sequence from HRSV(Memphis-37)__AIY60640.1__F-del_DSCav1_mut8 (opt4)
  source 1..1765: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19841 - RNA, 1765 nt, synthetic construct
  misc_feature 1..1765: note = mRNA product Design i-3 comprising derived and/or modified sequence from HRSV(Memphis-37)__AIY60640.1__F-del_DSCav1_mut8 (opt5)
  source 1..1765: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19842 - RNA, 1765 nt, synthetic construct
  misc_feature 1..1765: note = mRNA product Design i-3 comprising derived and/or modified sequence from HRSV(Memphis-37)__AIY60640.1__F-del_DSCav1_mut8 (opt6)
  source 1..1765: mol_type = other RNA
gggagaaagcttaccatggaactacccatactaaaaacaaacgcaattacaacaatacttgccgcagtaaccttatgctttgcctcatcccaaaacataacagaagaattttatcaatcaacatgctccgcagtatcaaaaggatacctaggcgctctaagaacaggatggtacacatccgtaatcacaatagaactatccaatataaaagaaataaaatgtaatggaacagatgcaaaagttaaattaataaaacaagaactagacaaatacaaaaacgcagttaccgatctccaactattaatgcaatcaacaccagctgcaggaagtggaagcgccatagcaagcggaatagcagtctgcaaagtattacatcttgaaggcgaagtaaacaaaatcaaaaatgccctcctctcaacaaacaaagctgtagtatccctatcaggatgcggtgtatctgttcttacatttaaagtactcgatctaaaaaactacatcgataaacagttacttccaatactcaacaaacaatcatgtagcataccaaacatagaaacagtaatagaatttcaacaaaaaaacaatcgactactcgaaataactagagaattttctgtaaacgctggagtaaccacaccagtgtctacctatatgcttacaaatagcgaactcctatcactaatcaatgacatgccaataacaaatgaccagaaaaaactcatgtcaaataacgtacaaatagtacgacaacaaagctactccataatgtgcataatcaaagaagaagtattagcctacgttgttcaactaccattatatggagttatagacactccatgctggaaattacatacaagcccactctgtacaacaaacacaaaagaaggctcaaacatatgcttaacaagaacagatagaggatggtactgcgataacgcaggctcagtctcattttttccacaagccgaaacctgcaaagtacaatcaaatagagttttttgcgacacaatgaactcactcactctaccaagtgaagtaaatctctgtaatatcgacatattcaacccaaaatatgactgcaaaataatgacatctaaaaccgatgtatcctcaagcgtaatcacatcattaggagctatagtttcctgctacggtaaaacaaaatgcacagcatccaacaaatgtcgcggtatcatcaaaacattctccaacggatgtgattacgtatcaaacaaaggtgtcgacaccgtaagcgtaggcaacactttatactatgtaaacaaacaagaaggacaaagtctatatgtaaaaggagaaccaataataaacttctatgaccccctagtattcccttccgacgaatttgatgcaagcatttcacaagttaacgaaaaaatcaatcaatcccttgctttcataagaaaatcagacgaattactacacaacgtaaacgtaggaaaaagcacaacaaatatcatgattacaacaataataattgtaataatagtaatactcctcttacttatagcagtcggcttattcctttactgcaaagcaagataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19843 - RNA, 1765 nt, synthetic construct
  misc_feature 1..1765: note = mRNA product Design i-3 comprising derived and/or modified sequence from HRSV(Memphis-37)__AIY60640.1__F-del_DSCav1_mut8 (opt11)
  source 1..1765: mol_type = other RNA
gggagaaagcttaccatggaactccccatcctaaaaaccaacgcaatcaccaccatcctcgccgccgtaacactctgctttgcaagctcccaaaacatcaccgaagaattttaccaatctacctgcagcgccgtatctaaaggatacctaggagccctcagaaccggttggtacacctctgtcatcacaatagaactctccaacatcaaagaaatcaaatgcaacggcaccgacgccaaagtcaaactcatcaaacaagaactcgacaaatataaaaacgccgtaaccgacctccaactcctcatgcaatccacccccgccgccggcagtggctccgctatcgcctccggaatcgccgtttgcaaagtcctgcacctagaaggcgaagtcaacaaaatcaaaaacgccctgctctcaaccaacaaagctgtcgtaagcctctccggctgcggagtctccgtccttaccttcaaagtactcgaccttaaaaactacatcgacaaacaacttctccccatactcaataaacaatcctgctccatacccaacatcgaaacagtcatcgagttccaacagaaaaataaccgcctcctcgaaataacccgcgagttctccgtcaacgcaggcgtcaccaccccagtctccacctacatgctgacaaactccgaactcctatccctcatcaacgacatgcccatcaccaacgaccaaaagaaactcatgagcaataacgtccaaatcgtacgacaacaatcctacagcatcatgtgtatcatcaaagaagaagtactcgcctacgtcgtccaactcccactatacggcgtcatcgacacaccatgctggaaacttcacacctccccactctgcaccacaaacacaaaagaaggctccaacatctgccttacccgaaccgaccgcgggtggtactgcgacaacgccggatcagtctcgttctttccccaagccgaaacctgcaaagtacaatcaaatcgcgtcttctgcgacaccatgaactccttaacactaccatccgaagtaaacctctgcaacatagacatcttcaacccaaaatacgactgcaaaatcatgacctccaaaaccgacgtatcctcctccgtaatcaccagcctcggcgcaatagtctcatgctacggcaaaaccaaatgcaccgcctccaacaaatgccgcggcatcataaaaactttctctaacggatgcgactacgtcagcaacaaaggcgtcgacaccgtatccgtaggtaatacactttactacgtcaataaacaagaaggccaatccctctacgtcaaaggagaacccatcataaacttctacgaccccctcgtcttcccctccgacgagttcgacgcctccatcagccaggtcaacgaaaagatcaaccaatcactcgccttcatccgcaaaagcgacgaactcctccacaacgtaaacgtcggcaaatccacaaccaacataatgatcaccactatcatcatcgtgataatcgtcattttacttctcctcatcgccgtaggcctcttcctatactgcaaagcccgctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19844 - protein, 256 aa, synthetic construct; identical to SEQ ID NO: 9684
  REGION 1..256: note = derived and/or modified protein sequence (wt) from HRSV(Memphis-37)__AIY60638.1__M

SEQ ID NO: 19845 - RNA, 771 nt, synthetic construct
  misc_feature 1..771: note = derived and/or modified CDS sequence (wt) from HRSV(Memphis-37)__AIY60638.1__M
  source 1..771: mol_type = other RNA
atggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaa

SEQ ID NO: 19846 - RNA, 771 nt, synthetic construct; identical to SEQ ID NO: 9686
  misc_feature 1..771: note = derived and/or modified CDS sequence (opt1) from HRSV(Memphis-37)__AIY60638.1__M
  source 1..771: mol_type = other RNA

SEQ ID NO: 19847 - RNA, 771 nt, synthetic construct; identical to SEQ ID NO: 9687
  misc_feature 1..771: note = derived and/or modified CDS sequence (opt2) from HRSV(Memphis-37)__AIY60638.1__M
  source 1..771: mol_type = other RNA

SEQ ID NO: 19848 - RNA, 771 nt, synthetic construct; identical to SEQ ID NO: 9688
  misc_feature 1..771: note = derived and/or modified CDS sequence (opt3) from HRSV(Memphis-37)__AIY60638.1__M
  source 1..771: mol_type = other RNA

SEQ ID NO: 19849 - RNA, 771 nt, synthetic construct; identical to SEQ ID NO: 9689
  misc_feature 1..771: note = derived and/or modified CDS sequence (opt4) from HRSV(Memphis-37)__AIY60638.1__M
  source 1..771: mol_type = other RNA

SEQ ID NO: 19850 - RNA, 771 nt, synthetic construct; identical to SEQ ID NO: 9690
  misc_feature 1..771: note = derived and/or modified CDS sequence (opt5) from HRSV(Memphis-37)__AIY60638.1__M
  source 1..771: mol_type = other RNA

SEQ ID NO: 19851 - RNA, 771 nt, synthetic construct
  misc_feature 1..771: note = derived and/or modified CDS sequence (opt6) from HRSV(Memphis-37)__AIY60638.1__M
  source 1..771: mol_type = other RNA
atggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaa

SEQ ID NO: 19852 - RNA, 771 nt, synthetic construct
  misc_feature 1..771: note = derived and/or modified CDS sequence (opt11) from HRSV(Memphis-37)__AIY60638.1__M
  source 1..771: mol_type = other RNA
atggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaa

SEQ ID NO: 19853 - RNA, 1047 nt, synthetic construct
  misc_feature 1..1047: note = mRNA product Design a-1 comprising derived and/or modified sequence from HRSV(Memphis-37)__AIY60638.1__M (wt)
  source 1..1047: mol_type = other RNA
gggagagtcccgcagtcggcgtccagcggctctgcttgttcgtgtgtgtgtcgttgcaggccttattcaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19854 - RNA, 1047 nt, synthetic construct; identical to SEQ ID NO: 9694
  misc_feature 1..1047: note = mRNA product Design a-1 comprising derived and/or modified sequence from HRSV(Memphis-37)__AIY60638.1__M (opt1)
  source 1..1047: mol_type = other RNA

SEQ ID NO: 19855 - RNA, 1047 nt, synthetic construct; identical to SEQ ID NO: 9695
  misc_feature 1..1047: note = mRNA product Design a-1 comprising derived and/or modified sequence from HRSV(Memphis-37)__AIY60638.1__M (opt2)
  source 1..1047: mol_type = other RNA

SEQ ID NO: 19856 - RNA, 1047 nt, synthetic construct; identical to SEQ ID NO: 9696
  misc_feature 1..1047: note = mRNA product Design a-1 comprising derived and/or modified sequence from HRSV(Memphis-37)__AIY60638.1__M (opt3)
  source 1..1047: mol_type = other RNA

SEQ ID NO: 19857 - RNA, 1047 nt, synthetic construct; identical to SEQ ID NO: 9697
  misc_feature 1..1047: note = mRNA product Design a-1 comprising derived and/or modified sequence from HRSV(Memphis-37)__AIY60638.1__M (opt4)
  source 1..1047: mol_type = other RNA

SEQ ID NO: 19858 - RNA, 1047 nt, synthetic construct; identical to SEQ ID NO: 9698
  misc_feature 1..1047: note = mRNA product Design a-1 comprising derived and/or modified sequence from HRSV(Memphis-37)__AIY60638.1__M (opt5)
  source 1..1047: mol_type = other RNA

SEQ ID NO: 19859 - RNA, 1047 nt, synthetic construct
  misc_feature 1..1047: note = mRNA product Design a-1 comprising derived and/or modified sequence from HRSV(Memphis-37)__AIY60638.1__M (opt6)
  source 1..1047: mol_type = other RNA
gggagagtcccgcagtcggcgtccagcggctctgcttgttcgtgtgtgtgtcgttgcaggccttattcaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19860 - RNA, 1047 nt, synthetic construct
  misc_feature 1..1047: note = mRNA product Design a-1 comprising derived and/or modified sequence from HRSV(Memphis-37)__AIY60638.1__M (opt11)
  source 1..1047: mol_type = other RNA
gggagagtcccgcagtcggcgtccagcggctctgcttgttcgtgtgtgtgtcgttgcaggccttattcaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19861 - RNA, 1066 nt, synthetic construct
  misc_feature 1..1066: note = mRNA product Design a-2 comprising derived and/or modified sequence from HRSV(Memphis-37)__AIY60638.1__M (wt)
  source 1..1066: mol_type = other RNA
gggagagtccgctcagccaggttgcagaagcggcttagcgtgtgtcctaatcttctctctgcgtgtaggtaggcctgtgccgcaaacaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19862 - RNA, 1066 nt, synthetic construct; identical to SEQ ID NO: 9702
  misc_feature 1..1066: note = mRNA product Design a-2 comprising derived and/or modified sequence from HRSV(Memphis-37)__AIY60638.1__M (opt1)
  source 1..1066: mol_type = other RNA

SEQ ID NO: 19863 - RNA, 1066 nt, synthetic construct; identical to SEQ ID NO: 9703
  misc_feature 1..1066: note = mRNA product Design a-2 comprising derived and/or modified sequence from HRSV(Memphis-37)__AIY60638.1__M (opt2)
  source 1..1066: mol_type = other RNA

SEQ ID NO: 19864 - RNA, 1066 nt, synthetic construct; identical to SEQ ID NO: 9704
  misc_feature 1..1066: note = mRNA product Design a-2 comprising derived and/or modified sequence from HRSV(Memphis-37)__AIY60638.1__M (opt3)
  source 1..1066: mol_type = other RNA

SEQ ID NO: 19865 - RNA, 1066 nt, synthetic construct; identical to SEQ ID NO: 9705
  misc_feature 1..1066: note = mRNA product Design a-2 comprising derived and/or modified sequence from HRSV(Memphis-37)__AIY60638.1__M (opt4)
  source 1..1066: mol_type = other RNA

SEQ ID NO: 19866 - RNA, 1066 nt, synthetic construct; identical to SEQ ID NO: 9706
  misc_feature 1..1066: note = mRNA product Design a-2 comprising derived and/or modified sequence from HRSV(Memphis-37)__AIY60638.1__M (opt5)
  source 1..1066: mol_type = other RNA

SEQ ID NO: 19867 - RNA, 1066 nt, synthetic construct
  misc_feature 1..1066: note = mRNA product Design a-2 comprising derived and/or modified sequence from HRSV(Memphis-37)__AIY60638.1__M (opt6)
  source 1..1066: mol_type = other RNA
gggagagtccgctcagccaggttgcagaagcggcttagcgtgtgtcctaatcttctctctgcgtgtaggtaggcctgtgccgcaaacaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19868 - RNA, 1066 nt, synthetic construct
  misc_feature 1..1066: note = mRNA product Design a-2 comprising derived and/or modified sequence from HRSV(Memphis-37)__AIY60638.1__M (opt11)
  source 1..1066: mol_type = other RNA
gggagagtccgctcagccaggttgcagaagcggcttagcgtgtgtcctaatcttctctctgcgtgtaggtaggcctgtgccgcaaacaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19869 - RNA, 1144 nt, synthetic construct
  misc_feature 1..1144: note = mRNA product Design a-3 comprising derived and/or modified sequence from HRSV(Memphis-37)__AIY60638.1__M (wt)
  source 1..1144: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19870 - RNA, 1144 nt, synthetic construct; identical to SEQ ID NO: 9710
  misc_feature 1..1144: note = mRNA product Design a-3 comprising derived and/or modified sequence from HRSV(Memphis-37)__AIY60638.1__M (opt1)
  source 1..1144: mol_type = other RNA

SEQ ID NO: 19871 - RNA, 1144 nt, synthetic construct; identical to SEQ ID NO: 9711
  misc_feature 1..1144: note = mRNA product Design a-3 comprising derived and/or modified sequence from HRSV(Memphis-37)__AIY60638.1__M (opt2)
  source 1..1144: mol_type = other RNA

SEQ ID NO: 19872 - RNA, 1144 nt, synthetic construct; identical to SEQ ID NO: 9712
  misc_feature 1..1144: note = mRNA product Design a-3 comprising derived and/or modified sequence from HRSV(Memphis-37)__AIY60638.1__M (opt3)
  source 1..1144: mol_type = other RNA

SEQ ID NO: 19873 - RNA, 1144 nt, synthetic construct; identical to SEQ ID NO: 9713
  misc_feature 1..1144: note = mRNA product Design a-3 comprising derived and/or modified sequence from HRSV(Memphis-37)__AIY60638.1__M (opt4)
  source 1..1144: mol_type = other RNA

SEQ ID NO: 19874 - RNA, 1144 nt, synthetic construct; identical to SEQ ID NO: 9714
  misc_feature 1..1144: note = mRNA product Design a-3 comprising derived and/or modified sequence from HRSV(Memphis-37)__AIY60638.1__M (opt5)
  source 1..1144: mol_type = other RNA

SEQ ID NO: 19875 - RNA, 1144 nt, synthetic construct
  misc_feature 1..1144: note = mRNA product Design a-3 comprising derived and/or modified sequence from HRSV(Memphis-37)__AIY60638.1__M (opt6)
  source 1..1144: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19876 - RNA, 1144 nt, synthetic construct
  misc_feature 1..1144: note = mRNA product Design a-3 comprising derived and/or modified sequence from HRSV(Memphis-37)__AIY60638.1__M (opt11)
  source 1..1144: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19877 - RNA, 1093 nt, synthetic construct
  misc_feature 1..1093: note = mRNA product Design a-4 comprising derived and/or modified sequence from HRSV(Memphis-37)__AIY60638.1__M (wt)
  source 1..1093: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19878 - RNA, 1093 nt, synthetic construct; identical to SEQ ID NO: 9718
  misc_feature 1..1093: note = mRNA product Design a-4 comprising derived and/or modified sequence from HRSV(Memphis-37)__AIY60638.1__M (opt1)
  source 1..1093: mol_type = other RNA

SEQ ID NO: 19879 - RNA, 1093 nt, synthetic construct; identical to SEQ ID NO: 9719
  misc_feature 1..1093: note = mRNA product Design a-4 comprising derived and/or modified sequence from HRSV(Memphis-37)__AIY60638.1__M (opt2)
  source 1..1093: mol_type = other RNA

SEQ ID NO: 19880 - RNA, 1093 nt, synthetic construct; identical to SEQ ID NO: 9720
  misc_feature 1..1093: note = mRNA product Design a-4 comprising derived and/or modified sequence from HRSV(Memphis-37)__AIY60638.1__M (opt3)
  source 1..1093: mol_type = other RNA

SEQ ID NO: 19881 - RNA, 1093 nt, synthetic construct; identical to SEQ ID NO: 9721
  misc_feature 1..1093: note = mRNA product Design a-4 comprising derived and/or modified sequence from HRSV(Memphis-37)__AIY60638.1__M (opt4)
  source 1..1093: mol_type = other RNA

SEQ ID NO: 19882 - RNA, 1093 nt, synthetic construct; identical to SEQ ID NO: 9722
  misc_feature 1..1093: note = mRNA product Design a-4 comprising derived and/or modified sequence from HRSV(Memphis-37)__AIY60638.1__M (opt5)
  source 1..1093: mol_type = other RNA

SEQ ID NO: 19883 - RNA, 1093 nt, synthetic construct
  misc_feature 1..1093: note = mRNA product Design a-4 comprising derived and/or modified sequence from HRSV(Memphis-37)__AIY60638.1__M (opt6)
  source 1..1093: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19884 - RNA, 1093 nt, synthetic construct
  misc_feature 1..1093: note = mRNA product Design a-4 comprising derived and/or modified sequence from HRSV(Memphis-37)__AIY60638.1__M (opt11)
  source 1..1093: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19885 - RNA, 1039 nt, synthetic construct
  misc_feature 1..1039: note = mRNA product Design a-5 comprising derived and/or modified sequence from HRSV(Memphis-37)__AIY60638.1__M (wt)
  source 1..1039: mol_type = other RNA
gggagactttcccattctgtagcagaatttggtgttgcctgtggtcttggtcccgcggagaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19886 - RNA, 1039 nt, synthetic construct; identical to SEQ ID NO: 9726
  misc_feature 1..1039: note = mRNA product Design a-5 comprising derived and/or modified sequence from HRSV(Memphis-37)__AIY60638.1__M (opt1)
  source 1..1039: mol_type = other RNA

SEQ ID NO: 19887 - RNA, 1039 nt, synthetic construct; identical to SEQ ID NO: 9727
  misc_feature 1..1039: note = mRNA product Design a-5 comprising derived and/or modified sequence from HRSV(Memphis-37)__AIY60638.1__M (opt2)
  source 1..1039: mol_type = other RNA

SEQ ID NO: 19888 - RNA, 1039 nt, synthetic construct; identical to SEQ ID NO: 9728
  misc_feature 1..1039: note = mRNA product Design a-5 comprising derived and/or modified sequence from HRSV(Memphis-37)__AIY60638.1__M (opt3)
  source 1..1039: mol_type = other RNA

SEQ ID NO: 19889 - RNA, 1039 nt, synthetic construct; identical to SEQ ID NO: 9729
  misc_feature 1..1039: note = mRNA product Design a-5 comprising derived and/or modified sequence from HRSV(Memphis-37)__AIY60638.1__M (opt4)
  source 1..1039: mol_type = other RNA

SEQ ID NO: 19890 - RNA, 1039 nt, synthetic construct; identical to SEQ ID NO: 9730
  misc_feature 1..1039: note = mRNA product Design a-5 comprising derived and/or modified sequence from HRSV(Memphis-37)__AIY60638.1__M (opt5)
  source 1..1039: mol_type = other RNA

SEQ ID NO: 19891 - RNA, 1039 nt, synthetic construct
  misc_feature 1..1039: note = mRNA product Design a-5 comprising derived and/or modified sequence from HRSV(Memphis-37)__AIY60638.1__M (opt6)
  source 1..1039: mol_type = other RNA
gggagactttcccattctgtagcagaatttggtgttgcctgtggtcttggtcccgcggagaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19892 - RNA, 1039 nt, synthetic construct
  misc_feature 1..1039: note = mRNA product Design a-5 comprising derived and/or modified sequence from HRSV(Memphis-37)__AIY60638.1__M (opt11)
  source 1..1039: mol_type = other RNA
gggagactttcccattctgtagcagaatttggtgttgcctgtggtcttggtcccgcggagaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19893 - RNA, 1220 nt, synthetic construct
  misc_feature 1..1220: note = mRNA product Design b-1 comprising derived and/or modified sequence from HRSV(Memphis-37)__AIY60638.1__M (wt)
  source 1..1220: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19894 - RNA, 1220 nt, synthetic construct; identical to SEQ ID NO: 9734
  misc_feature 1..1220: note = mRNA product Design b-1 comprising derived and/or modified sequence from HRSV(Memphis-37)__AIY60638.1__M (opt1)
  source 1..1220: mol_type = other RNA

SEQ ID NO: 19895 - RNA, 1220 nt, synthetic construct; identical to SEQ ID NO: 9735
  misc_feature 1..1220: note = mRNA product Design b-1 comprising derived and/or modified sequence from HRSV(Memphis-37)__AIY60638.1__M (opt2)
  source 1..1220: mol_type = other RNA

SEQ ID NO: 19896 - RNA, 1220 nt, synthetic construct; identical to SEQ ID NO: 9736
  misc_feature 1..1220: note = mRNA product Design b-1 comprising derived and/or modified sequence from HRSV(Memphis-37)__AIY60638.1__M (opt3)
  source 1..1220: mol_type = other RNA

SEQ ID NO: 19897 - RNA, 1220 nt, synthetic construct; identical to SEQ ID NO: 9737
  misc_feature 1..1220: note = mRNA product Design b-1 comprising derived and/or modified sequence from HRSV(Memphis-37)__AIY60638.1__M (opt4)
  source 1..1220: mol_type = other RNA

SEQ ID NO: 19898 - RNA, 1220 nt, synthetic construct; identical to SEQ ID NO: 9738
  misc_feature 1..1220: note = mRNA product Design b-1 comprising derived and/or modified sequence from HRSV(Memphis-37)__AIY60638.1__M (opt5)
  source 1..1220: mol_type = other RNA

SEQ ID NO: 19899 - RNA, 1220 nt, synthetic construct
  misc_feature 1..1220: note = mRNA product Design b-1 comprising derived and/or modified sequence from HRSV(Memphis-37)__AIY60638.1__M (opt6)
  source 1..1220: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19900 - RNA, 1220 nt, synthetic construct
  misc_feature 1..1220: note = mRNA product Design b-1 comprising derived and/or modified sequence from HRSV(Memphis-37)__AIY60638.1__M (opt11)
  source 1..1220: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19901 - RNA, 1040 nt, synthetic construct
  misc_feature 1..1040: note = mRNA product Design b-2 comprising derived and/or modified sequence from HRSV(Memphis-37)__AIY60638.1__M (wt)
  source 1..1040: mol_type = other RNA
gggagagcctctgctggagtccggggagtggcgttggctgctagagcgaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19902 - RNA, 1040 nt, synthetic construct; identical to SEQ ID NO: 9742
  misc_feature 1..1040: note = mRNA product Design b-2 comprising derived and/or modified sequence from HRSV(Memphis-37)__AIY60638.1__M (opt1)
  source 1..1040: mol_type = other RNA

SEQ ID NO: 19903 - RNA, 1040 nt, synthetic construct; identical to SEQ ID NO: 9743
  misc_feature 1..1040: note = mRNA product Design b-2 comprising derived and/or modified sequence from HRSV(Memphis-37)__AIY60638.1__M (opt2)
  source 1..1040: mol_type = other RNA

SEQ ID NO: 19904 - RNA, 1040 nt, synthetic construct; identical to SEQ ID NO: 9744
  misc_feature 1..1040: note = mRNA product Design b-2 comprising derived and/or modified sequence from HRSV(Memphis-37)__AIY60638.1__M (opt3)
  source 1..1040: mol_type = other RNA

SEQ ID NO: 19905 - RNA, 1040 nt, synthetic construct; identical to SEQ ID NO: 9745
  misc_feature 1..1040: note = mRNA product Design b-2 comprising derived and/or modified sequence from HRSV(Memphis-37)__AIY60638.1__M (opt4)
  source 1..1040: mol_type = other RNA

SEQ ID NO: 19906 - RNA, 1040 nt, synthetic construct; identical to SEQ ID NO: 9746
  misc_feature 1..1040: note = mRNA product Design b-2 comprising derived and/or modified sequence from HRSV(Memphis-37)__AIY60638.1__M (opt5)
  source 1..1040: mol_type = other RNA

SEQ ID NO: 19907 - RNA, 1040 nt, synthetic construct
  misc_feature 1..1040: note = mRNA product Design b-2 comprising derived and/or modified sequence from HRSV(Memphis-37)__AIY60638.1__M (opt6)
  source 1..1040: mol_type = other RNA
gggagagcctctgctggagtccggggagtggcgttggctgctagagcgaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19908 - RNA, 1040 nt, synthetic construct
  misc_feature 1..1040: note = mRNA product Design b-2 comprising derived and/or modified sequence from HRSV(Memphis-37)__AIY60638.1__M (opt11)
  source 1..1040: mol_type = other RNA
gggagagcctctgctggagtccggggagtggcgttggctgctagagcgaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19909 - RNA, 1060 nt, synthetic construct
  misc_feature 1..1060: note = mRNA product Design b-3 comprising derived and/or modified sequence from HRSV(Memphis-37)__AIY60638.1__M (wt)
  source 1..1060: mol_type = other RNA
gggagagtcccgcagtcggcgtccagcggctctgcttgttcgtgtgtgtgtcgttgcaggccttattcaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19910 - RNA, 1060 nt, synthetic construct; identical to SEQ ID NO: 9750
  misc_feature 1..1060: note = mRNA product Design b-3 comprising derived and/or modified sequence from HRSV(Memphis-37)__AIY60638.1__M (opt1)
  source 1..1060: mol_type = other RNA

SEQ ID NO: 19911 - RNA, 1060 nt, synthetic construct; identical to SEQ ID NO: 9751
  misc_feature 1..1060: note = mRNA product Design b-3 comprising derived and/or modified sequence from HRSV(Memphis-37)__AIY60638.1__M (opt2)
  source 1..1060: mol_type = other RNA

SEQ ID NO: 19912 - RNA, 1060 nt, synthetic construct; identical to SEQ ID NO: 9752
  misc_feature 1..1060: note = mRNA product Design b-3 comprising derived and/or modified sequence from HRSV(Memphis-37)__AIY60638.1__M (opt3)
  source 1..1060: mol_type = other RNA

SEQ ID NO: 19913 - RNA, 1060 nt, synthetic construct; identical to SEQ ID NO: 9753
  misc_feature 1..1060: note = mRNA product Design b-3 comprising derived and/or modified sequence from HRSV(Memphis-37)__AIY60638.1__M (opt4)
  source 1..1060: mol_type = other RNA

SEQ ID NO: 19914 - RNA, 1060 nt, synthetic construct; identical to SEQ ID NO: 9754
  misc_feature 1..1060: note = mRNA product Design b-3 comprising derived and/or modified sequence from HRSV(Memphis-37)__AIY60638.1__M (opt5)
  source 1..1060: mol_type = other RNA

SEQ ID NO: 19915 - RNA, 1060 nt, synthetic construct
  misc_feature 1..1060: note = mRNA product Design b-3 comprising derived and/or modified sequence from HRSV(Memphis-37)__AIY60638.1__M (opt6)
  source 1..1060: mol_type = other RNA
gggagagtcccgcagtcggcgtccagcggctctgcttgttcgtgtgtgtgtcgttgcaggccttattcaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19916 - RNA, 1060 nt, synthetic construct
  misc_feature 1..1060: note = mRNA product Design b-3 comprising derived and/or modified sequence from HRSV(Memphis-37)__AIY60638.1__M (opt11)
  source 1..1060: mol_type = other RNA
gggagagtcccgcagtcggcgtccagcggctctgcttgttcgtgtgtgtgtcgttgcaggccttattcaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19917 - RNA, 1111 nt, synthetic construct
  misc_feature 1..1111: note = mRNA product Design b-4 comprising derived and/or modified sequence from HRSV(Memphis-37)__AIY60638.1__M (wt)
  source 1..1111: mol_type = other RNA
gggagagtcccgcagtcggcgtccagcggctctgcttgttcgtgtgtgtgtcgttgcaggccttattcaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19918 - RNA, 1111 nt, synthetic construct; identical to SEQ ID NO: 9758
  misc_feature 1..1111: note = mRNA product Design b-4 comprising derived and/or modified sequence from HRSV(Memphis-37)__AIY60638.1__M (opt1)
  source 1..1111: mol_type = other RNA

SEQ ID NO: 19919 - RNA, 1111 nt, synthetic construct; identical to SEQ ID NO: 9759
  misc_feature 1..1111: note = mRNA product Design b-4 comprising derived and/or modified sequence from HRSV(Memphis-37)__AIY60638.1__M (opt2)
  source 1..1111: mol_type = other RNA

SEQ ID NO: 19920 - RNA, 1111 nt, synthetic construct; identical to SEQ ID NO: 9760
  misc_feature 1..1111: note = mRNA product Design b-4 comprising derived and/or modified sequence from HRSV(Memphis-37)__AIY60638.1__M (opt3)
  source 1..1111: mol_type = other RNA

SEQ ID NO: 19921 - RNA, 1111 nt, synthetic construct; identical to SEQ ID NO: 9761
  misc_feature 1..1111: note = mRNA product Design b-4 comprising derived and/or modified sequence from HRSV(Memphis-37)__AIY60638.1__M (opt4)
  source 1..1111: mol_type = other RNA

SEQ ID NO: 19922 - RNA, 1111 nt, synthetic construct; identical to SEQ ID NO: 9762
  misc_feature 1..1111: note = mRNA product Design b-4 comprising derived and/or modified sequence from HRSV(Memphis-37)__AIY60638.1__M (opt5)
  source 1..1111: mol_type = other RNA

SEQ ID NO: 19923 - RNA, 1111 nt, synthetic construct
  misc_feature 1..1111: note = mRNA product Design b-4 comprising derived and/or modified sequence from HRSV(Memphis-37)__AIY60638.1__M (opt6)
  source 1..1111: mol_type = other RNA
gggagagtcccgcagtcggcgtccagcggctctgcttgttcgtgtgtgtgtcgttgcaggccttattcaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19924 - RNA, 1111 nt, synthetic construct
  misc_feature 1..1111: note = mRNA product Design b-4 comprising derived and/or modified sequence from HRSV(Memphis-37)__AIY60638.1__M (opt11)
  source 1..1111: mol_type = other RNA
gggagagtcccgcagtcggcgtccagcggctctgcttgttcgtgtgtgtgtcgttgcaggccttattcaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19925 - RNA, 1173 nt, synthetic construct
  misc_feature 1..1173: note = mRNA product Design b-5 comprising derived and/or modified sequence from HRSV(Memphis-37)__AIY60638.1__M (wt)
  source 1..1173: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19926 - RNA, 1173 nt, synthetic construct; identical to SEQ ID NO: 9766
  misc_feature 1..1173: note = mRNA product Design b-5 comprising derived and/or modified sequence from HRSV(Memphis-37)__AIY60638.1__M (opt1)
  source 1..1173: mol_type = other RNA

SEQ ID NO: 19927 - RNA, 1173 nt, synthetic construct; identical to SEQ ID NO: 9767
  misc_feature 1..1173: note = mRNA product Design b-5 comprising derived and/or modified sequence from HRSV(Memphis-37)__AIY60638.1__M (opt2)
  source 1..1173: mol_type = other RNA

SEQ ID NO: 19928 - RNA, 1173 nt, synthetic construct; identical to SEQ ID NO: 9768
  misc_feature 1..1173: note = mRNA product Design b-5 comprising derived and/or modified sequence from HRSV(Memphis-37)__AIY60638.1__M (opt3)
  source 1..1173: mol_type = other RNA

SEQ ID NO: 19929 - RNA, 1173 nt, synthetic construct; identical to SEQ ID NO: 9769
  misc_feature 1..1173: note = mRNA product Design b-5 comprising derived and/or modified sequence from HRSV(Memphis-37)__AIY60638.1__M (opt4)
  source 1..1173: mol_type = other RNA

SEQ ID NO: 19930 - RNA, 1173 nt, synthetic construct; identical to SEQ ID NO: 9770
  misc_feature 1..1173: note = mRNA product Design b-5 comprising derived and/or modified sequence from HRSV(Memphis-37)__AIY60638.1__M (opt5)
  source 1..1173: mol_type = other RNA

SEQ ID NO: 19931 - RNA, 1173 nt, synthetic construct
  misc_feature 1..1173: note = mRNA product Design b-5 comprising derived and/or modified sequence from HRSV(Memphis-37)__AIY60638.1__M (opt6)
  source 1..1173: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19932 - RNA, 1173 nt, synthetic construct
  misc_feature 1..1173: note = mRNA product Design b-5 comprising derived and/or modified sequence from HRSV(Memphis-37)__AIY60638.1__M (opt11)
  source 1..1173: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19933 - RNA, 1079 nt, synthetic construct
  misc_feature 1..1079: note = mRNA product Design c-1 comprising derived and/or modified sequence from HRSV(Memphis-37)__AIY60638.1__M (wt)
  source 1..1079: mol_type = other RNA
gggagagtccgctcagccaggttgcagaagcggcttagcgtgtgtcctaatcttctctctgcgtgtaggtaggcctgtgccgcaaacaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19934 - RNA, 1079 nt, synthetic construct; identical to SEQ ID NO: 9774
  misc_feature 1..1079: note = mRNA product Design c-1 comprising derived and/or modified sequence from HRSV(Memphis-37)__AIY60638.1__M (opt1)
  source 1..1079: mol_type = other RNA

SEQ ID NO: 19935 - RNA, 1079 nt, synthetic construct; identical to SEQ ID NO: 9775
  misc_feature 1..1079: note = mRNA product Design c-1 comprising derived and/or modified sequence from HRSV(Memphis-37)__AIY60638.1__M (opt2)
  source 1..1079: mol_type = other RNA

SEQ ID NO: 19936 - RNA, 1079 nt, synthetic construct; identical to SEQ ID NO: 9776
  misc_feature 1..1079: note = mRNA product Design c-1 comprising derived and/or modified sequence from HRSV(Memphis-37)__AIY60638.1__M (opt3)
  source 1..1079: mol_type = other RNA

SEQ ID NO: 19937 - RNA, 1079 nt, synthetic construct; identical to SEQ ID NO: 9777
  misc_feature 1..1079: note = mRNA product Design c-1 comprising derived and/or modified sequence from HRSV(Memphis-37)__AIY60638.1__M (opt4)
  source 1..1079: mol_type = other RNA

SEQ ID NO: 19938 - RNA, 1079 nt, synthetic construct; identical to SEQ ID NO: 9778
  misc_feature 1..1079: note = mRNA product Design c-1 comprising derived and/or modified sequence from HRSV(Memphis-37)__AIY60638.1__M (opt5)
  source 1..1079: mol_type = other RNA

SEQ ID NO: 19939 - RNA, 1079 nt, synthetic construct
  misc_feature 1..1079: note = mRNA product Design c-1 comprising derived and/or modified sequence from HRSV(Memphis-37)__AIY60638.1__M (opt6)
  source 1..1079: mol_type = other RNA
gggagagtccgctcagccaggttgcagaagcggcttagcgtgtgtcctaatcttctctctgcgtgtaggtaggcctgtgccgcaaacaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19940 - RNA, 1079 nt, synthetic construct
  misc_feature 1..1079: note = mRNA product Design c-1 comprising derived and/or modified sequence from HRSV(Memphis-37)__AIY60638.1__M (opt11)
  source 1..1079: mol_type = other RNA
gggagagtccgctcagccaggttgcagaagcggcttagcgtgtgtcctaatcttctctctgcgtgtaggtaggcctgtgccgcaaacaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19941 - RNA, 1169 nt, synthetic construct
  misc_feature 1..1169: note = mRNA product Design c-2 comprising derived and/or modified sequence from HRSV(Memphis-37)__AIY60638.1__M (wt)
  source 1..1169: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19942 - RNA, 1169 nt, synthetic construct; identical to SEQ ID NO: 9782
  misc_feature 1..1169: note = mRNA product Design c-2 comprising derived and/or modified sequence from HRSV(Memphis-37)__AIY60638.1__M (opt1)
  source 1..1169: mol_type = other RNA

SEQ ID NO: 19943 - RNA, 1169 nt, synthetic construct; identical to SEQ ID NO: 9783
  misc_feature 1..1169: note = mRNA product Design c-2 comprising derived and/or modified sequence from HRSV(Memphis-37)__AIY60638.1__M (opt2)
  source 1..1169: mol_type = other RNA

SEQ ID NO: 19944 - RNA, 1169 nt, synthetic construct; identical to SEQ ID NO: 9784
  misc_feature 1..1169: note = mRNA product Design c-2 comprising derived and/or modified sequence from HRSV(Memphis-37)__AIY60638.1__M (opt3)
  source 1..1169: mol_type = other RNA

SEQ ID NO: 19945 - RNA, 1169 nt, synthetic construct; identical to SEQ ID NO: 9785
  misc_feature 1..1169: note = mRNA product Design c-2 comprising derived and/or modified sequence from HRSV(Memphis-37)__AIY60638.1__M (opt4)
  source 1..1169: mol_type = other RNA

SEQ ID NO: 19946 - RNA, 1169 nt, synthetic construct; identical to SEQ ID NO: 9786
  misc_feature 1..1169: note = mRNA product Design c-2 comprising derived and/or modified sequence from HRSV(Memphis-37)__AIY60638.1__M (opt5)
  source 1..1169: mol_type = other RNA

SEQ ID NO: 19947 - RNA, 1169 nt, synthetic construct
  misc_feature 1..1169: note = mRNA product Design c-2 comprising derived and/or modified sequence from HRSV(Memphis-37)__AIY60638.1__M (opt6)
  source 1..1169: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19948 - RNA, 1169 nt, synthetic construct
  misc_feature 1..1169: note = mRNA product Design c-2 comprising derived and/or modified sequence from HRSV(Memphis-37)__AIY60638.1__M (opt11)
  source 1..1169: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19949 - RNA, 1146 nt, synthetic construct
  misc_feature 1..1146: note = mRNA product Design c-3 comprising derived and/or modified sequence from HRSV(Memphis-37)__AIY60638.1__M (wt)
  source 1..1146: mol_type = other RNA
gggagagtccgctcagccaggttgcagaagcggcttagcgtgtgtcctaatcttctctctgcgtgtaggtaggcctgtgccgcaaacaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19950 - RNA, 1146 nt, synthetic construct; identical to SEQ ID NO: 9790
  misc_feature 1..1146: note = mRNA product Design c-3 comprising derived and/or modified sequence from HRSV(Memphis-37)__AIY60638.1__M (opt1)
  source 1..1146: mol_type = other RNA

SEQ ID NO: 19951 - RNA, 1146 nt, synthetic construct; identical to SEQ ID NO: 9791
  misc_feature 1..1146: note = mRNA product Design c-3 comprising derived and/or modified sequence from HRSV(Memphis-37)__AIY60638.1__M (opt2)
  source 1..1146: mol_type = other RNA

SEQ ID NO: 19952 - RNA, 1146 nt, synthetic construct; identical to SEQ ID NO: 9792
  misc_feature 1..1146: note = mRNA product Design c-3 comprising derived and/or modified sequence from HRSV(Memphis-37)__AIY60638.1__M (opt3)
  source 1..1146: mol_type = other RNA

SEQ ID NO: 19953 - RNA, 1146 nt, synthetic construct; identical to SEQ ID NO: 9793
  misc_feature 1..1146: note = mRNA product Design c-3 comprising derived and/or modified sequence from HRSV(Memphis-37)__AIY60638.1__M (opt4)
  source 1..1146: mol_type = other RNA

SEQ ID NO: 19954 - RNA, 1146 nt, synthetic construct; identical to SEQ ID NO: 9794
  misc_feature 1..1146: note = mRNA product Design c-3 comprising derived and/or modified sequence from HRSV(Memphis-37)__AIY60638.1__M (opt5)
  source 1..1146: mol_type = other RNA

SEQ ID NO: 19955 - RNA, 1146 nt, synthetic construct
  misc_feature 1..1146: note = mRNA product Design c-3 comprising derived and/or modified sequence from HRSV(Memphis-37)__AIY60638.1__M (opt6)
  source 1..1146: mol_type = other RNA
gggagagtccgctcagccaggttgcagaagcggcttagcgtgtgtcctaatcttctctctgcgtgtaggtaggcctgtgccgcaaacaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19956 - RNA, 1146 nt, synthetic construct
  misc_feature 1..1146: note = mRNA product Design c-3 comprising derived and/or modified sequence from HRSV(Memphis-37)__AIY60638.1__M (opt11)
  source 1..1146: mol_type = other RNA
gggagagtccgctcagccaggttgcagaagcggcttagcgtgtgtcctaatcttctctctgcgtgtaggtaggcctgtgccgcaaacaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19957 - RNA, 1142 nt, synthetic construct
  misc_feature 1..1142: note = mRNA product Design c-4 comprising derived and/or modified sequence from HRSV(Memphis-37)__AIY60638.1__M (wt)
  source 1..1142: mol_type = other RNA
gggagagtccgctcagccaggttgcagaagcggcttagcgtgtgtcctaatcttctctctgcgtgtaggtaggcctgtgccgcaaacaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19958 - RNA, 1142 nt, synthetic construct; identical to SEQ ID NO: 9798
  misc_feature 1..1142: note = mRNA product Design c-4 comprising derived and/or modified sequence from HRSV(Memphis-37)__AIY60638.1__M (opt1)
  source 1..1142: mol_type = other RNA

SEQ ID NO: 19959 - RNA, 1142 nt, synthetic construct; identical to SEQ ID NO: 9799
  misc_feature 1..1142: note = mRNA product Design c-4 comprising derived and/or modified sequence from HRSV(Memphis-37)__AIY60638.1__M (opt2)
  source 1..1142: mol_type = other RNA

SEQ ID NO: 19960 - RNA, 1142 nt, synthetic construct; identical to SEQ ID NO: 9800
  misc_feature 1..1142: note = mRNA product Design c-4 comprising derived and/or modified sequence from HRSV(Memphis-37)__AIY60638.1__M (opt3)
  source 1..1142: mol_type = other RNA

SEQ ID NO: 19961 - RNA, 1142 nt, synthetic construct; identical to SEQ ID NO: 9801
  misc_feature 1..1142: note = mRNA product Design c-4 comprising derived and/or modified sequence from HRSV(Memphis-37)__AIY60638.1__M (opt4)
  source 1..1142: mol_type = other RNA

SEQ ID NO: 19962 - RNA, 1142 nt, synthetic construct; identical to SEQ ID NO: 9802
  misc_feature 1..1142: note = mRNA product Design c-4 comprising derived and/or modified sequence from HRSV(Memphis-37)__AIY60638.1__M (opt5)
  source 1..1142: mol_type = other RNA

SEQ ID NO: 19963 - RNA, 1142 nt, synthetic construct
  misc_feature 1..1142: note = mRNA product Design c-4 comprising derived and/or modified sequence from HRSV(Memphis-37)__AIY60638.1__M (opt6)
  source 1..1142: mol_type = other RNA
gggagagtccgctcagccaggttgcagaagcggcttagcgtgtgtcctaatcttctctctgcgtgtaggtaggcctgtgccgcaaacaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19964 - RNA, 1142 nt, synthetic construct
  misc_feature 1..1142: note = mRNA product Design c-4 comprising derived and/or modified sequence from HRSV(Memphis-37)__AIY60638.1__M (opt11)
  source 1..1142: mol_type = other RNA
gggagagtccgctcagccaggttgcagaagcggcttagcgtgtgtcctaatcttctctctgcgtgtaggtaggcctgtgccgcaaacaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19965 - RNA, 1060 nt, synthetic construct
  misc_feature 1..1060: note = mRNA product Design c-5 comprising derived and/or modified sequence from HRSV(Memphis-37)__AIY60638.1__M (wt)
  source 1..1060: mol_type = other RNA
gggagagcggctcggccattttgtcccagtcagtccggaggctgcggctgcagaagtaccgcctgcggagtaactgcaaagaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19966 - RNA, 1060 nt, synthetic construct; identical to SEQ ID NO: 9806
  misc_feature 1..1060: note = mRNA product Design c-5 comprising derived and/or modified sequence from HRSV(Memphis-37)__AIY60638.1__M (opt1)
  source 1..1060: mol_type = other RNA

SEQ ID NO: 19967 - RNA, 1060 nt, synthetic construct; identical to SEQ ID NO: 9807
  misc_feature 1..1060: note = mRNA product Design c-5 comprising derived and/or modified sequence from HRSV(Memphis-37)__AIY60638.1__M (opt2)
  source 1..1060: mol_type = other RNA

SEQ ID NO: 19968 - RNA, 1060 nt, synthetic construct; identical to SEQ ID NO: 9808
  misc_feature 1..1060: note = mRNA product Design c-5 comprising derived and/or modified sequence from HRSV(Memphis-37)__AIY60638.1__M (opt3)
  source 1..1060: mol_type = other RNA

SEQ ID NO: 19969 - RNA, 1060 nt, synthetic construct; identical to SEQ ID NO: 9809
  misc_feature 1..1060: note = mRNA product Design c-5 comprising derived and/or modified sequence from HRSV(Memphis-37)__AIY60638.1__M (opt4)
  source 1..1060: mol_type = other RNA

SEQ ID NO: 19970 - RNA, 1060 nt, synthetic construct; identical to SEQ ID NO: 9810
  misc_feature 1..1060: note = mRNA product Design c-5 comprising derived and/or modified sequence from HRSV(Memphis-37)__AIY60638.1__M (opt5)
  source 1..1060: mol_type = other RNA

SEQ ID NO: 19971 - RNA, 1060 nt, synthetic construct
  misc_feature 1..1060: note = mRNA product Design c-5 comprising derived and/or modified sequence from HRSV(Memphis-37)__AIY60638.1__M (opt6)
  source 1..1060: mol_type = other RNA
gggagagcggctcggccattttgtcccagtcagtccggaggctgcggctgcagaagtaccgcctgcggagtaactgcaaagaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19972 - RNA, 1060 nt, synthetic construct
  misc_feature 1..1060: note = mRNA product Design c-5 comprising derived and/or modified sequence from HRSV(Memphis-37)__AIY60638.1__M (opt11)
  source 1..1060: mol_type = other RNA
gggagagcggctcggccattttgtcccagtcagtccggaggctgcggctgcagaagtaccgcctgcggagtaactgcaaagaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19973 - RNA, 1069 nt, synthetic construct
  misc_feature 1..1069: note = mRNA product Design d-1 comprising derived and/or modified sequence from HRSV(Memphis-37)__AIY60638.1__M (wt)
  source 1..1069: mol_type = other RNA
gggagacccgtgacccggaagttgtacggctacgcgactttccctcccacaaaccctcgcgcccttcctttcctacttgggcccggcagaaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19974 - RNA, 1069 nt, synthetic construct; identical to SEQ ID NO: 9814
  misc_feature 1..1069: note = mRNA product Design d-1 comprising derived and/or modified sequence from HRSV(Memphis-37)__AIY60638.1__M (opt1)
  source 1..1069: mol_type = other RNA

SEQ ID NO: 19975 - RNA, 1069 nt, synthetic construct; identical to SEQ ID NO: 9815
  misc_feature 1..1069: note = mRNA product Design d-1 comprising derived and/or modified sequence from HRSV(Memphis-37)__AIY60638.1__M (opt2)
  source 1..1069: mol_type = other RNA

SEQ ID NO: 19976 - RNA, 1069 nt, synthetic construct; identical to SEQ ID NO: 9816
  misc_feature 1..1069: note = mRNA product Design d-1 comprising derived and/or modified sequence from HRSV(Memphis-37)__AIY60638.1__M (opt3)
  source 1..1069: mol_type = other RNA

SEQ ID NO: 19977 - RNA, 1069 nt, synthetic construct; identical to SEQ ID NO: 9817
  misc_feature 1..1069: note = mRNA product Design d-1 comprising derived and/or modified sequence from HRSV(Memphis-37)__AIY60638.1__M (opt4)
  source 1..1069: mol_type = other RNA

SEQ ID NO: 19978 - RNA, 1069 nt, synthetic construct; identical to SEQ ID NO: 9818
  misc_feature 1..1069: note = mRNA product Design d-1 comprising derived and/or modified sequence from HRSV(Memphis-37)__AIY60638.1__M (opt5)
  source 1..1069: mol_type = other RNA

SEQ ID NO: 19979 - RNA, 1069 nt, synthetic construct
  misc_feature 1..1069: note = mRNA product Design d-1 comprising derived and/or modified sequence from HRSV(Memphis-37)__AIY60638.1__M (opt6)
  source 1..1069: mol_type = other RNA
gggagacccgtgacccggaagttgtacggctacgcgactttccctcccacaaaccctcgcgcccttcctttcctacttgggcccggcagaaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19980 - RNA, 1069 nt, synthetic construct
  misc_feature 1..1069: note = mRNA product Design d-1 comprising derived and/or modified sequence from HRSV(Memphis-37)__AIY60638.1__M (opt11)
  source 1..1069: mol_type = other RNA
gggagacccgtgacccggaagttgtacggctacgcgactttccctcccacaaaccctcgcgcccttcctttcctacttgggcccggcagaaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19981 - RNA, 1124 nt, synthetic construct
  misc_feature 1..1124: note = mRNA product Design d-2 comprising derived and/or modified sequence from HRSV(Memphis-37)__AIY60638.1__M (wt)
  source 1..1124: mol_type = other RNA
gggagagcggctcggccattttgtcccagtcagtccggaggctgcggctgcagaagtaccgcctgcggagtaactgcaaagaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19982 - RNA, 1124 nt, synthetic construct; identical to SEQ ID NO: 9822
  misc_feature 1..1124: note = mRNA product Design d-2 comprising derived and/or modified sequence from HRSV(Memphis-37)__AIY60638.1__M (opt1)
  source 1..1124: mol_type = other RNA

SEQ ID NO: 19983 - RNA, 1124 nt, synthetic construct; identical to SEQ ID NO: 9823
  misc_feature 1..1124: note = mRNA product Design d-2 comprising derived and/or modified sequence from HRSV(Memphis-37)__AIY60638.1__M (opt2)
  source 1..1124: mol_type = other RNA

SEQ ID NO: 19984 - RNA, 1124 nt, synthetic construct; identical to SEQ ID NO: 9824
  misc_feature 1..1124: note = mRNA product Design d-2 comprising derived and/or modified sequence from HRSV(Memphis-37)__AIY60638.1__M (opt3)
  source 1..1124: mol_type = other RNA

SEQ ID NO: 19985 - RNA, 1124 nt, synthetic construct; identical to SEQ ID NO: 9825
  misc_feature 1..1124: note = mRNA product Design d-2 comprising derived and/or modified sequence from HRSV(Memphis-37)__AIY60638.1__M (opt4)
  source 1..1124: mol_type = other RNA

SEQ ID NO: 19986 - RNA, 1124 nt, synthetic construct; identical to SEQ ID NO: 9826
  misc_feature 1..1124: note = mRNA product Design d-2 comprising derived and/or modified sequence from HRSV(Memphis-37)__AIY60638.1__M (opt5)
  source 1..1124: mol_type = other RNA

SEQ ID NO: 19987 - RNA, 1124 nt, synthetic construct
  misc_feature 1..1124: note = mRNA product Design d-2 comprising derived and/or modified sequence from HRSV(Memphis-37)__AIY60638.1__M (opt6)
  source 1..1124: mol_type = other RNA
gggagagcggctcggccattttgtcccagtcagtccggaggctgcggctgcagaagtaccgcctgcggagtaactgcaaagaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19988 - RNA, 1124 nt, synthetic construct
  misc_feature 1..1124: note = mRNA product Design d-2 comprising derived and/or modified sequence from HRSV(Memphis-37)__AIY60638.1__M (opt11)
  source 1..1124: mol_type = other RNA
gggagagcggctcggccattttgtcccagtcagtccggaggctgcggctgcagaagtaccgcctgcggagtaactgcaaagaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19989 - RNA, 1440 nt, synthetic construct
  misc_feature 1..1440: note = mRNA product Design d-3 comprising derived and/or modified sequence from HRSV(Memphis-37)__AIY60638.1__M (wt)
  source 1..1440: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19990 - RNA, 1440 nt, synthetic construct; identical to SEQ ID NO: 9830
  misc_feature 1..1440: note = mRNA product Design d-3 comprising derived and/or modified sequence from HRSV(Memphis-37)__AIY60638.1__M (opt1)
  source 1..1440: mol_type = other RNA

SEQ ID NO: 19991 - RNA, 1440 nt, synthetic construct; identical to SEQ ID NO: 9831
  misc_feature 1..1440: note = mRNA product Design d-3 comprising derived and/or modified sequence from HRSV(Memphis-37)__AIY60638.1__M (opt2)
  source 1..1440: mol_type = other RNA

SEQ ID NO: 19992 - RNA, 1440 nt, synthetic construct; identical to SEQ ID NO: 9832
  misc_feature 1..1440: note = mRNA product Design d-3 comprising derived and/or modified sequence from HRSV(Memphis-37)__AIY60638.1__M (opt3)
  source 1..1440: mol_type = other RNA

SEQ ID NO: 19993 - RNA, 1440 nt, synthetic construct; identical to SEQ ID NO: 9833
  misc_feature 1..1440: note = mRNA product Design d-3 comprising derived and/or modified sequence from HRSV(Memphis-37)__AIY60638.1__M (opt4)
  source 1..1440: mol_type = other RNA

SEQ ID NO: 19994 - RNA, 1440 nt, synthetic construct; identical to SEQ ID NO: 9834
  misc_feature 1..1440: note = mRNA product Design d-3 comprising derived and/or modified sequence from HRSV(Memphis-37)__AIY60638.1__M (opt5)
  source 1..1440: mol_type = other RNA

SEQ ID NO: 19995 - RNA, 1440 nt, synthetic construct
  misc_feature 1..1440: note = mRNA product Design d-3 comprising derived and/or modified sequence from HRSV(Memphis-37)__AIY60638.1__M (opt6)
  source 1..1440: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19996 - RNA, 1440 nt, synthetic construct
  misc_feature 1..1440: note = mRNA product Design d-3 comprising derived and/or modified sequence from HRSV(Memphis-37)__AIY60638.1__M (opt11)
  source 1..1440: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19997 - RNA, 1123 nt, synthetic construct
  misc_feature 1..1123: note = mRNA product Design d-4 comprising derived and/or modified sequence from HRSV(Memphis-37)__AIY60638.1__M (wt)
  source 1..1123: mol_type = other RNA
gggagagtcccgcagtcggcgtccagcggctctgcttgttcgtgtgtgtgtcgttgcaggccttattcaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19998 - RNA, 1123 nt, synthetic construct; identical to SEQ ID NO: 9838
  misc_feature 1..1123: note = mRNA product Design d-4 comprising derived and/or modified sequence from HRSV(Memphis-37)__AIY60638.1__M (opt1)
  source 1..1123: mol_type = other RNA

SEQ ID NO: 19999 - RNA, 1123 nt, synthetic construct; identical to SEQ ID NO: 9839
  misc_feature 1..1123: note = mRNA product Design d-4 comprising derived and/or modified sequence from HRSV(Memphis-37)__AIY60638.1__M (opt2)
  source 1..1123: mol_type = other RNA

SEQ ID NO: 20000 - RNA, 1123 nt, synthetic construct; identical to SEQ ID NO: 9840
  misc_feature 1..1123: note = mRNA product Design d-4 comprising derived and/or modified sequence from HRSV(Memphis-37)__AIY60638.1__M (opt3)
  source 1..1123: mol_type = other RNA

SEQ ID NO: 20001 - RNA, 1123 nt, synthetic construct; identical to SEQ ID NO: 9841
  misc_feature 1..1123: note = mRNA product Design d-4 comprising derived and/or modified sequence from HRSV(Memphis-37)__AIY60638.1__M (opt4)
  source 1..1123: mol_type = other RNA

SEQ ID NO: 20002 - RNA, 1123 nt, synthetic construct; identical to SEQ ID NO: 9842
  misc_feature 1..1123: note = mRNA product Design d-4 comprising derived and/or modified sequence from HRSV(Memphis-37)__AIY60638.1__M (opt5)
  source 1..1123: mol_type = other RNA

SEQ ID NO: 20003 - RNA, 1123 nt, synthetic construct
  misc_feature 1..1123: note = mRNA product Design d-4 comprising derived and/or modified sequence from HRSV(Memphis-37)__AIY60638.1__M (opt6)
  source 1..1123: mol_type = other RNA
gggagagtcccgcagtcggcgtccagcggctctgcttgttcgtgtgtgtgtcgttgcaggccttattcaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20004 - RNA, 1123 nt, synthetic construct
  misc_feature 1..1123: note = mRNA product Design d-4 comprising derived and/or modified sequence from HRSV(Memphis-37)__AIY60638.1__M (opt11)
  source 1..1123: mol_type = other RNA
gggagagtcccgcagtcggcgtccagcggctctgcttgttcgtgtgtgtgtcgttgcaggccttattcaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20005 - RNA, 1220 nt, synthetic construct
  misc_feature 1..1220: note = mRNA product Design d-5 comprising derived and/or modified sequence from HRSV(Memphis-37)__AIY60638.1__M (wt)
  source 1..1220: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20006 - RNA, 1220 nt, synthetic construct; identical to SEQ ID NO: 9846
  misc_feature 1..1220: note = mRNA product Design d-5 comprising derived and/or modified sequence from HRSV(Memphis-37)__AIY60638.1__M (opt1)
  source 1..1220: mol_type = other RNA

SEQ ID NO: 20007 - RNA, 1220 nt, synthetic construct; identical to SEQ ID NO: 9847
  misc_feature 1..1220: note = mRNA product Design d-5 comprising derived and/or modified sequence from HRSV(Memphis-37)__AIY60638.1__M (opt2)
  source 1..1220: mol_type = other RNA

SEQ ID NO: 20008 - RNA, 1220 nt, synthetic construct; identical to SEQ ID NO: 9848
  misc_feature 1..1220: note = mRNA product Design d-5 comprising derived and/or modified sequence from HRSV(Memphis-37)__AIY60638.1__M (opt3)
  source 1..1220: mol_type = other RNA

SEQ ID NO: 20009 - RNA, 1220 nt, synthetic construct; identical to SEQ ID NO: 9849
  misc_feature 1..1220: note = mRNA product Design d-5 comprising derived and/or modified sequence from HRSV(Memphis-37)__AIY60638.1__M (opt4)
  source 1..1220: mol_type = other RNA

SEQ ID NO: 20010 - RNA, 1220 nt, synthetic construct; identical to SEQ ID NO: 9850
  misc_feature 1..1220: note = mRNA product Design d-5 comprising derived and/or modified sequence from HRSV(Memphis-37)__AIY60638.1__M (opt5)
  source 1..1220: mol_type = other RNA

SEQ ID NO: 20011 - RNA, 1220 nt, synthetic construct
  misc_feature 1..1220: note = mRNA product Design d-5 comprising derived and/or modified sequence from HRSV(Memphis-37)__AIY60638.1__M (opt6)
  source 1..1220: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20012 - RNA, 1220 nt, synthetic construct
  misc_feature 1..1220: note = mRNA product Design d-5 comprising derived and/or modified sequence from HRSV(Memphis-37)__AIY60638.1__M (opt11)
  source 1..1220: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20013 - RNA, 1100 nt, synthetic construct
  misc_feature 1..1100: note = mRNA product Design e-1 comprising derived and/or modified sequence from HRSV(Memphis-37)__AIY60638.1__M (wt)
  source 1..1100: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20014 - RNA, 1100 nt, synthetic construct; identical to SEQ ID NO: 9854
  misc_feature 1..1100: note = mRNA product Design e-1 comprising derived and/or modified sequence from HRSV(Memphis-37)__AIY60638.1__M (opt1)
  source 1..1100: mol_type = other RNA

SEQ ID NO: 20015 - RNA, 1100 nt, synthetic construct; identical to SEQ ID NO: 9855
  misc_feature 1..1100: note = mRNA product Design e-1 comprising derived and/or modified sequence from HRSV(Memphis-37)__AIY60638.1__M (opt2)
  source 1..1100: mol_type = other RNA

SEQ ID NO: 20016 - RNA, 1100 nt, synthetic construct; identical to SEQ ID NO: 9856
  misc_feature 1..1100: note = mRNA product Design e-1 comprising derived and/or modified sequence from HRSV(Memphis-37)__AIY60638.1__M (opt3)
  source 1..1100: mol_type = other RNA

SEQ ID NO: 20017 - RNA, 1100 nt, synthetic construct; identical to SEQ ID NO: 9857
  misc_feature 1..1100: note = mRNA product Design e-1 comprising derived and/or modified sequence from HRSV(Memphis-37)__AIY60638.1__M (opt4)
  source 1..1100: mol_type = other RNA

SEQ ID NO: 20018 - RNA, 1100 nt, synthetic construct; identical to SEQ ID NO: 9858
  misc_feature 1..1100: note = mRNA product Design e-1 comprising derived and/or modified sequence from HRSV(Memphis-37)__AIY60638.1__M (opt5)
  source 1..1100: mol_type = other RNA

SEQ ID NO: 20019 - RNA, 1100 nt, synthetic construct
  misc_feature 1..1100: note = mRNA product Design e-1 comprising derived and/or modified sequence from HRSV(Memphis-37)__AIY60638.1__M (opt6)
  source 1..1100: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20020 - RNA, 1100 nt, synthetic construct
  misc_feature 1..1100: note = mRNA product Design e-1 comprising derived and/or modified sequence from HRSV(Memphis-37)__AIY60638.1__M (opt11)
  source 1..1100: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20021 - RNA, 1082 nt, synthetic construct
  misc_feature 1..1082: note = mRNA product Design e-2 comprising derived and/or modified sequence from HRSV(Memphis-37)__AIY60638.1__M (wt)
  source 1..1082: mol_type = other RNA
gggagacccgtgacccggaagttgtacggctacgcgactttccctcccacaaaccctcgcgcccttcctttcctacttgggcccggcagaaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20022 - RNA, 1082 nt, synthetic construct; identical to SEQ ID NO: 9862
  misc_feature 1..1082: note = mRNA product Design e-2 comprising derived and/or modified sequence from HRSV(Memphis-37)__AIY60638.1__M (opt1)
  source 1..1082: mol_type = other RNA

SEQ ID NO: 20023 - RNA, 1082 nt, synthetic construct; identical to SEQ ID NO: 9863
  misc_feature 1..1082: note = mRNA product Design e-2 comprising derived and/or modified sequence from HRSV(Memphis-37)__AIY60638.1__M (opt2)
  source 1..1082: mol_type = other RNA

SEQ ID NO: 20024 - RNA, 1082 nt, synthetic construct; identical to SEQ ID NO: 9864
  misc_feature 1..1082: note = mRNA product Design e-2 comprising derived and/or modified sequence from HRSV(Memphis-37)__AIY60638.1__M (opt3)
  source 1..1082: mol_type = other RNA

SEQ ID NO: 20025 - RNA, 1082 nt, synthetic construct; identical to SEQ ID NO: 9865
  misc_feature 1..1082: note = mRNA product Design e-2 comprising derived and/or modified sequence from HRSV(Memphis-37)__AIY60638.1__M (opt4)
  source 1..1082: mol_type = other RNA

SEQ ID NO: 20026 - RNA, 1082 nt, synthetic construct; identical to SEQ ID NO: 9866
  misc_feature 1..1082: note = mRNA product Design e-2 comprising derived and/or modified sequence from HRSV(Memphis-37)__AIY60638.1__M (opt5)
  source 1..1082: mol_type = other RNA

SEQ ID NO: 20027 - RNA, 1082 nt, synthetic construct
  misc_feature 1..1082: note = mRNA product Design e-2 comprising derived and/or modified sequence from HRSV(Memphis-37)__AIY60638.1__M (opt6)
  source 1..1082: mol_type = other RNA
gggagacccgtgacccggaagttgtacggctacgcgactttccctcccacaaaccctcgcgcccttcctttcctacttgggcccggcagaaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20028 - RNA, 1082 nt, synthetic construct
  misc_feature 1..1082: note = mRNA product Design e-2 comprising derived and/or modified sequence from HRSV(Memphis-37)__AIY60638.1__M (opt11)
  source 1..1082: mol_type = other RNA
gggagacccgtgacccggaagttgtacggctacgcgactttccctcccacaaaccctcgcgcccttcctttcctacttgggcccggcagaaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20029 - RNA, 1052 nt, synthetic construct
  misc_feature 1..1052: note = mRNA product Design e-3 comprising derived and/or modified sequence from HRSV(Memphis-37)__AIY60638.1__M (wt)
  source 1..1052: mol_type = other RNA
gggagactttcccattctgtagcagaatttggtgttgcctgtggtcttggtcccgcggagaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20030 - RNA, 1052 nt, synthetic construct; identical to SEQ ID NO: 9870
  misc_feature 1..1052: note = mRNA product Design e-3 comprising derived and/or modified sequence from HRSV(Memphis-37)__AIY60638.1__M (opt1)
  source 1..1052: mol_type = other RNA

SEQ ID NO: 20031 - RNA, 1052 nt, synthetic construct; identical to SEQ ID NO: 9871
  misc_feature 1..1052: note = mRNA product Design e-3 comprising derived and/or modified sequence from HRSV(Memphis-37)__AIY60638.1__M (opt2)
  source 1..1052: mol_type = other RNA

SEQ ID NO: 20032 - RNA, 1052 nt, synthetic construct; identical to SEQ ID NO: 9872
  misc_feature 1..1052: note = mRNA product Design e-3 comprising derived and/or modified sequence from HRSV(Memphis-37)__AIY60638.1__M (opt3)
  source 1..1052: mol_type = other RNA

SEQ ID NO: 20033 - RNA, 1052 nt, synthetic construct; identical to SEQ ID NO: 9873
  misc_feature 1..1052: note = mRNA product Design e-3 comprising derived and/or modified sequence from HRSV(Memphis-37)__AIY60638.1__M (opt4)
  source 1..1052: mol_type = other RNA

SEQ ID NO: 20034 - RNA, 1052 nt, synthetic construct; identical to SEQ ID NO: 9874
  misc_feature 1..1052: note = mRNA product Design e-3 comprising derived and/or modified sequence from HRSV(Memphis-37)__AIY60638.1__M (opt5)
  source 1..1052: mol_type = other RNA

SEQ ID NO: 20035 - RNA, 1052 nt, synthetic construct
  misc_feature 1..1052: note = mRNA product Design e-3 comprising derived and/or modified sequence from HRSV(Memphis-37)__AIY60638.1__M (opt6)
  source 1..1052: mol_type = other RNA
gggagactttcccattctgtagcagaatttggtgttgcctgtggtcttggtcccgcggagaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20036 - RNA, 1052 nt, synthetic construct
  misc_feature 1..1052: note = mRNA product Design e-3 comprising derived and/or modified sequence from HRSV(Memphis-37)__AIY60638.1__M (opt11)
  source 1..1052: mol_type = other RNA
gggagactttcccattctgtagcagaatttggtgttgcctgtggtcttggtcccgcggagaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20037 - RNA, 1106 nt, synthetic construct
  misc_feature 1..1106: note = mRNA product Design e-4 comprising derived and/or modified sequence from HRSV(Memphis-37)__AIY60638.1__M (wt)
  source 1..1106: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20038 - RNA, 1106 nt, synthetic construct; identical to SEQ ID NO: 9878
  misc_feature 1..1106: note = mRNA product Design e-4 comprising derived and/or modified sequence from HRSV(Memphis-37)__AIY60638.1__M (opt1)
  source 1..1106: mol_type = other RNA

SEQ ID NO: 20039 - RNA, 1106 nt, synthetic construct; identical to SEQ ID NO: 9879
  misc_feature 1..1106: note = mRNA product Design e-4 comprising derived and/or modified sequence from HRSV(Memphis-37)__AIY60638.1__M (opt2)
  source 1..1106: mol_type = other RNA

SEQ ID NO: 20040 - RNA, 1106 nt, synthetic construct; identical to SEQ ID NO: 9880
  misc_feature 1..1106: note = mRNA product Design e-4 comprising derived and/or modified sequence from HRSV(Memphis-37)__AIY60638.1__M (opt3)
  source 1..1106: mol_type = other RNA

SEQ ID NO: 20041 - RNA, 1106 nt, synthetic construct; identical to SEQ ID NO: 9881
  misc_feature 1..1106: note = mRNA product Design e-4 comprising derived and/or modified sequence from HRSV(Memphis-37)__AIY60638.1__M (opt4)
  source 1..1106: mol_type = other RNA

SEQ ID NO: 20042 - RNA, 1106 nt, synthetic construct; identical to SEQ ID NO: 9882
  misc_feature 1..1106: note = mRNA product Design e-4 comprising derived and/or modified sequence from HRSV(Memphis-37)__AIY60638.1__M (opt5)
  source 1..1106: mol_type = other RNA

SEQ ID NO: 20043 - RNA, 1106 nt, synthetic construct
  misc_feature 1..1106: note = mRNA product Design e-4 comprising derived and/or modified sequence from HRSV(Memphis-37)__AIY60638.1__M (opt6)
  source 1..1106: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20044 - RNA, 1106 nt, synthetic construct
  misc_feature 1..1106: note = mRNA product Design e-4 comprising derived and/or modified sequence from HRSV(Memphis-37)__AIY60638.1__M (opt11)
  source 1..1106: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20045 - RNA, 1073 nt, synthetic construct
  misc_feature 1..1073: note = mRNA product Design e-5 comprising derived and/or modified sequence from HRSV(Memphis-37)__AIY60638.1__M (wt)
  source 1..1073: mol_type = other RNA
gggagagcggctcggccattttgtcccagtcagtccggaggctgcggctgcagaagtaccgcctgcggagtaactgcaaagaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20046 - RNA, 1073 nt, synthetic construct; identical to SEQ ID NO: 9886
  misc_feature 1..1073: note = mRNA product Design e-5 comprising derived and/or modified sequence from HRSV(Memphis-37)__AIY60638.1__M (opt1)
  source 1..1073: mol_type = other RNA

SEQ ID NO: 20047 - RNA, 1073 nt, synthetic construct; identical to SEQ ID NO: 9887
  misc_feature 1..1073: note = mRNA product Design e-5 comprising derived and/or modified sequence from HRSV(Memphis-37)__AIY60638.1__M (opt2)
  source 1..1073: mol_type = other RNA

SEQ ID NO: 20048 - RNA, 1073 nt, synthetic construct; identical to SEQ ID NO: 9888
  misc_feature 1..1073: note = mRNA product Design e-5 comprising derived and/or modified sequence from HRSV(Memphis-37)__AIY60638.1__M (opt3)
  source 1..1073: mol_type = other RNA

SEQ ID NO: 20049 - RNA, 1073 nt, synthetic construct; identical to SEQ ID NO: 9889
  misc_feature 1..1073: note = mRNA product Design e-5 comprising derived and/or modified sequence from HRSV(Memphis-37)__AIY60638.1__M (opt4)
  source 1..1073: mol_type = other RNA

SEQ ID NO: 20050 - RNA, 1073 nt, synthetic construct; identical to SEQ ID NO: 9890
  misc_feature 1..1073: note = mRNA product Design e-5 comprising derived and/or modified sequence from HRSV(Memphis-37)__AIY60638.1__M (opt5)
  source 1..1073: mol_type = other RNA

SEQ ID NO: 20051 - RNA, 1073 nt, synthetic construct
  misc_feature 1..1073: note = mRNA product Design e-5 comprising derived and/or modified sequence from HRSV(Memphis-37)__AIY60638.1__M (opt6)
  source 1..1073: mol_type = other RNA
gggagagcggctcggccattttgtcccagtcagtccggaggctgcggctgcagaagtaccgcctgcggagtaactgcaaagaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20052 - RNA, 1073 nt, synthetic construct
  misc_feature 1..1073: note = mRNA product Design e-5 comprising derived and/or modified sequence from HRSV(Memphis-37)__AIY60638.1__M (opt11)
  source 1..1073: mol_type = other RNA
gggagagcggctcggccattttgtcccagtcagtccggaggctgcggctgcagaagtaccgcctgcggagtaactgcaaagaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20053 - RNA, 1140 nt, synthetic construct
  misc_feature 1..1140: note = mRNA product Design e-6 comprising derived and/or modified sequence from HRSV(Memphis-37)__AIY60638.1__M (wt)
  source 1..1140: mol_type = other RNA
gggagagcggctcggccattttgtcccagtcagtccggaggctgcggctgcagaagtaccgcctgcggagtaactgcaaagaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20054 - RNA, 1140 nt, synthetic construct; identical to SEQ ID NO: 9894
  misc_feature 1..1140: note = mRNA product Design e-6 comprising derived and/or modified sequence from HRSV(Memphis-37)__AIY60638.1__M (opt1)
  source 1..1140: mol_type = other RNA

SEQ ID NO: 20055 - RNA, 1140 nt, synthetic construct; identical to SEQ ID NO: 9895
  misc_feature 1..1140: note = mRNA product Design e-6 comprising derived and/or modified sequence from HRSV(Memphis-37)__AIY60638.1__M (opt2)
  source 1..1140: mol_type = other RNA

SEQ ID NO: 20056 - RNA, 1140 nt, synthetic construct; identical to SEQ ID NO: 9896
  misc_feature 1..1140: note = mRNA product Design e-6 comprising derived and/or modified sequence from HRSV(Memphis-37)__AIY60638.1__M (opt3)
  source 1..1140: mol_type = other RNA

SEQ ID NO: 20057 - RNA, 1140 nt, synthetic construct; identical to SEQ ID NO: 9897
  misc_feature 1..1140: note = mRNA product Design e-6 comprising derived and/or modified sequence from HRSV(Memphis-37)__AIY60638.1__M (opt4)
  source 1..1140: mol_type = other RNA

SEQ ID NO: 20058 - RNA, 1140 nt, synthetic construct; identical to SEQ ID NO: 9898
  misc_feature 1..1140: note = mRNA product Design e-6 comprising derived and/or modified sequence from HRSV(Memphis-37)__AIY60638.1__M (opt5)
  source 1..1140: mol_type = other RNA

SEQ ID NO: 20059 - RNA, 1140 nt, synthetic construct
  misc_feature 1..1140: note = mRNA product Design e-6 comprising derived and/or modified sequence from HRSV(Memphis-37)__AIY60638.1__M (opt6)
  source 1..1140: mol_type = other RNA
gggagagcggctcggccattttgtcccagtcagtccggaggctgcggctgcagaagtaccgcctgcggagtaactgcaaagaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20060 - RNA, 1140 nt, synthetic construct
  misc_feature 1..1140: note = mRNA product Design e-6 comprising derived and/or modified sequence from HRSV(Memphis-37)__AIY60638.1__M (opt11)
  source 1..1140: mol_type = other RNA
gggagagcggctcggccattttgtcccagtcagtccggaggctgcggctgcagaagtaccgcctgcggagtaactgcaaagaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20061 - RNA, 1356 nt, synthetic construct
  misc_feature 1..1356: note = mRNA product Design f-1 comprising derived and/or modified sequence from HRSV(Memphis-37)__AIY60638.1__M (wt)
  source 1..1356: mol_type = other RNA
gggagagcggctcggccattttgtcccagtcagtccggaggctgcggctgcagaagtaccgcctgcggagtaactgcaaagaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20062 - RNA, 1356 nt, synthetic construct; identical to SEQ ID NO: 9902
  misc_feature 1..1356: note = mRNA product Design f-1 comprising derived and/or modified sequence from HRSV(Memphis-37)__AIY60638.1__M (opt1)
  source 1..1356: mol_type = other RNA

SEQ ID NO: 20063 - RNA, 1356 nt, synthetic construct; identical to SEQ ID NO: 9903
  misc_feature 1..1356: note = mRNA product Design f-1 comprising derived and/or modified sequence from HRSV(Memphis-37)__AIY60638.1__M (opt2)
  source 1..1356: mol_type = other RNA

SEQ ID NO: 20064 - RNA, 1356 nt, synthetic construct; identical to SEQ ID NO: 9904
  misc_feature 1..1356: note = mRNA product Design f-1 comprising derived and/or modified sequence from HRSV(Memphis-37)__AIY60638.1__M (opt3)
  source 1..1356: mol_type = other RNA

SEQ ID NO: 20065 - RNA, 1356 nt, synthetic construct; identical to SEQ ID NO: 9905
  misc_feature 1..1356: note = mRNA product Design f-1 comprising derived and/or modified sequence from HRSV(Memphis-37)__AIY60638.1__M (opt4)
  source 1..1356: mol_type = other RNA

SEQ ID NO: 20066 - RNA, 1356 nt, synthetic construct; identical to SEQ ID NO: 9906
  misc_feature 1..1356: note = mRNA product Design f-1 comprising derived and/or modified sequence from HRSV(Memphis-37)__AIY60638.1__M (opt5)
  source 1..1356: mol_type = other RNA

SEQ ID NO: 20067 - RNA, 1356 nt, synthetic construct
  misc_feature 1..1356: note = mRNA product Design f-1 comprising derived and/or modified sequence from HRSV(Memphis-37)__AIY60638.1__M (opt6)
  source 1..1356: mol_type = other RNA
gggagagcggctcggccattttgtcccagtcagtccggaggctgcggctgcagaagtaccgcctgcggagtaactgcaaagaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20068 - RNA, 1356 nt, synthetic construct
  misc_feature 1..1356: note = mRNA product Design f-1 comprising derived and/or modified sequence from HRSV(Memphis-37)__AIY60638.1__M (opt11)
  source 1..1356: mol_type = other RNA
gggagagcggctcggccattttgtcccagtcagtccggaggctgcggctgcagaagtaccgcctgcggagtaactgcaaagaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20069 - RNA, 1136 nt, synthetic construct
  misc_feature 1..1136: note = mRNA product Design f-2 comprising derived and/or modified sequence from HRSV(Memphis-37)__AIY60638.1__M (wt)
  source 1..1136: mol_type = other RNA
gggagagcggctcggccattttgtcccagtcagtccggaggctgcggctgcagaagtaccgcctgcggagtaactgcaaagaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20070 - RNA, 1136 nt, synthetic construct; identical to SEQ ID NO: 9910
  misc_feature 1..1136: note = mRNA product Design f-2 comprising derived and/or modified sequence from HRSV(Memphis-37)__AIY60638.1__M (opt1)
  source 1..1136: mol_type = other RNA

SEQ ID NO: 20071 - RNA, 1136 nt, synthetic construct; identical to SEQ ID NO: 9911
  misc_feature 1..1136: note = mRNA product Design f-2 comprising derived and/or modified sequence from HRSV(Memphis-37)__AIY60638.1__M (opt2)
  source 1..1136: mol_type = other RNA

SEQ ID NO: 20072 - RNA, 1136 nt, synthetic construct; identical to SEQ ID NO: 9912
  misc_feature 1..1136: note = mRNA product Design f-2 comprising derived and/or modified sequence from HRSV(Memphis-37)__AIY60638.1__M (opt3)
  source 1..1136: mol_type = other RNA

SEQ ID NO: 20073 - RNA, 1136 nt, synthetic construct; identical to SEQ ID NO: 9913
  misc_feature 1..1136: note = mRNA product Design f-2 comprising derived and/or modified sequence from HRSV(Memphis-37)__AIY60638.1__M (opt4)
  source 1..1136: mol_type = other RNA

SEQ ID NO: 20074 - RNA, 1136 nt, synthetic construct; identical to SEQ ID NO: 9914
  misc_feature 1..1136: note = mRNA product Design f-2 comprising derived and/or modified sequence from HRSV(Memphis-37)__AIY60638.1__M (opt5)
  source 1..1136: mol_type = other RNA

SEQ ID NO: 20075 - RNA, 1136 nt, synthetic construct
  misc_feature 1..1136: note = mRNA product Design f-2 comprising derived and/or modified sequence from HRSV(Memphis-37)__AIY60638.1__M (opt6)
  source 1..1136: mol_type = other RNA
gggagagcggctcggccattttgtcccagtcagtccggaggctgcggctgcagaagtaccgcctgcggagtaactgcaaagaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20076 - RNA, 1136 nt, synthetic construct
  misc_feature 1..1136: note = mRNA product Design f-2 comprising derived and/or modified sequence from HRSV(Memphis-37)__AIY60638.1__M (opt11)
  source 1..1136: mol_type = other RNA
gggagagcggctcggccattttgtcccagtcagtccggaggctgcggctgcagaagtaccgcctgcggagtaactgcaaagaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20077 - RNA, 1127 nt, synthetic construct
  misc_feature 1..1127: note = mRNA product Design f-3 comprising derived and/or modified sequence from HRSV(Memphis-37)__AIY60638.1__M (wt)
  source 1..1127: mol_type = other RNA
gggagagtcccgcagtcggcgtccagcggctctgcttgttcgtgtgtgtgtcgttgcaggccttattcaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20078 - RNA, 1127 nt, synthetic construct; identical to SEQ ID NO: 9918
  misc_feature 1..1127: note = mRNA product Design f-3 comprising derived and/or modified sequence from HRSV(Memphis-37)__AIY60638.1__M (opt1)
  source 1..1127: mol_type = other RNA

SEQ ID NO: 20079 - RNA, 1127 nt, synthetic construct; identical to SEQ ID NO: 9919
  misc_feature 1..1127: note = mRNA product Design f-3 comprising derived and/or modified sequence from HRSV(Memphis-37)__AIY60638.1__M (opt2)
  source 1..1127: mol_type = other RNA

SEQ ID NO: 20080 - RNA, 1127 nt, synthetic construct; identical to SEQ ID NO: 9920
  misc_feature 1..1127: note = mRNA product Design f-3 comprising derived and/or modified sequence from HRSV(Memphis-37)__AIY60638.1__M (opt3)
  source 1..1127: mol_type = other RNA

SEQ ID NO: 20081 - RNA, 1127 nt, synthetic construct; identical to SEQ ID NO: 9921
  misc_feature 1..1127: note = mRNA product Design f-3 comprising derived and/or modified sequence from HRSV(Memphis-37)__AIY60638.1__M (opt4)
  source 1..1127: mol_type = other RNA

SEQ ID NO: 20082 - RNA, 1127 nt, synthetic construct; identical to SEQ ID NO: 9922
  misc_feature 1..1127: note = mRNA product Design f-3 comprising derived and/or modified sequence from HRSV(Memphis-37)__AIY60638.1__M (opt5)
  source 1..1127: mol_type = other RNA

SEQ ID NO: 20083 - RNA, 1127 nt, synthetic construct
  misc_feature 1..1127: note = mRNA product Design f-3 comprising derived and/or modified sequence from HRSV(Memphis-37)__AIY60638.1__M (opt6)
  source 1..1127: mol_type = other RNA
gggagagtcccgcagtcggcgtccagcggctctgcttgttcgtgtgtgtgtcgttgcaggccttattcaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20084 - RNA, 1127 nt, synthetic construct
  misc_feature 1..1127: note = mRNA product Design f-3 comprising derived and/or modified sequence from HRSV(Memphis-37)__AIY60638.1__M (opt11)
  source 1..1127: mol_type = other RNA
gggagagtcccgcagtcggcgtccagcggctctgcttgttcgtgtgtgtgtcgttgcaggccttattcaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20085 - RNA, 1343 nt, synthetic construct
  misc_feature 1..1343: note = mRNA product Design f-4 comprising derived and/or modified sequence from HRSV(Memphis-37)__AIY60638.1__M (wt)
  source 1..1343: mol_type = other RNA
gggagagtcccgcagtcggcgtccagcggctctgcttgttcgtgtgtgtgtcgttgcaggccttattcaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20086 - RNA, 1343 nt, synthetic construct; identical to SEQ ID NO: 9926
  misc_feature 1..1343: note = mRNA product Design f-4 comprising derived and/or modified sequence from HRSV(Memphis-37)__AIY60638.1__M (opt1)
  source 1..1343: mol_type = other RNA

SEQ ID NO: 20087 - RNA, 1343 nt, synthetic construct; identical to SEQ ID NO: 9927
  misc_feature 1..1343: note = mRNA product Design f-4 comprising derived and/or modified sequence from HRSV(Memphis-37)__AIY60638.1__M (opt2)
  source 1..1343: mol_type = other RNA

SEQ ID NO: 20088 - RNA, 1343 nt, synthetic construct; identical to SEQ ID NO: 9928
  misc_feature 1..1343: note = mRNA product Design f-4 comprising derived and/or modified sequence from HRSV(Memphis-37)__AIY60638.1__M (opt3)
  source 1..1343: mol_type = other RNA

SEQ ID NO: 20089 - RNA, 1343 nt, synthetic construct; identical to SEQ ID NO: 9929
  misc_feature 1..1343: note = mRNA product Design f-4 comprising derived and/or modified sequence from HRSV(Memphis-37)__AIY60638.1__M (opt4)
  source 1..1343: mol_type = other RNA

SEQ ID NO: 20090 - RNA, 1343 nt, synthetic construct; identical to SEQ ID NO: 9930
  misc_feature 1..1343: note = mRNA product Design f-4 comprising derived and/or modified sequence from HRSV(Memphis-37)__AIY60638.1__M (opt5)
  source 1..1343: mol_type = other RNA

SEQ ID NO: 20091 - RNA, 1343 nt, synthetic construct
  misc_feature 1..1343: note = mRNA product Design f-4 comprising derived and/or modified sequence from HRSV(Memphis-37)__AIY60638.1__M (opt6)
  source 1..1343: mol_type = other RNA
gggagagtcccgcagtcggcgtccagcggctctgcttgttcgtgtgtgtgtcgttgcaggccttattcaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20092 - RNA, 1343 nt, synthetic construct
  misc_feature 1..1343: note = mRNA product Design f-4 comprising derived and/or modified sequence from HRSV(Memphis-37)__AIY60638.1__M (opt11)
  source 1..1343: mol_type = other RNA
gggagagtcccgcagtcggcgtccagcggctctgcttgttcgtgtgtgtgtcgttgcaggccttattcaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20093 - RNA, 1119 nt, synthetic construct
  misc_feature 1..1119: note = mRNA product Design f-5 comprising derived and/or modified sequence from HRSV(Memphis-37)__AIY60638.1__M (wt)
  source 1..1119: mol_type = other RNA
gggagactttcccattctgtagcagaatttggtgttgcctgtggtcttggtcccgcggagaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20094 - RNA, 1119 nt, synthetic construct; identical to SEQ ID NO: 9934
  misc_feature 1..1119: note = mRNA product Design f-5 comprising derived and/or modified sequence from HRSV(Memphis-37)__AIY60638.1__M (opt1)
  source 1..1119: mol_type = other RNA

SEQ ID NO: 20095 - RNA, 1119 nt, synthetic construct; identical to SEQ ID NO: 9935
  misc_feature 1..1119: note = mRNA product Design f-5 comprising derived and/or modified sequence from HRSV(Memphis-37)__AIY60638.1__M (opt2)
  source 1..1119: mol_type = other RNA

SEQ ID NO: 20096 - RNA, 1119 nt, synthetic construct; identical to SEQ ID NO: 9936
  misc_feature 1..1119: note = mRNA product Design f-5 comprising derived and/or modified sequence from HRSV(Memphis-37)__AIY60638.1__M (opt3)
  source 1..1119: mol_type = other RNA

SEQ ID NO: 20097 - RNA, 1119 nt, synthetic construct; identical to SEQ ID NO: 9937
  misc_feature 1..1119: note = mRNA product Design f-5 comprising derived and/or modified sequence from HRSV(Memphis-37)__AIY60638.1__M (opt4)
  source 1..1119: mol_type = other RNA

SEQ ID NO: 20098 - RNA, 1119 nt, synthetic construct; identical to SEQ ID NO: 9938
  misc_feature 1..1119: note = mRNA product Design f-5 comprising derived and/or modified sequence from HRSV(Memphis-37)__AIY60638.1__M (opt5)
  source 1..1119: mol_type = other RNA

SEQ ID NO: 20099 - RNA, 1119 nt, synthetic construct
  misc_feature 1..1119: note = mRNA product Design f-5 comprising derived and/or modified sequence from HRSV(Memphis-37)__AIY60638.1__M (opt6)
  source 1..1119: mol_type = other RNA
gggagactttcccattctgtagcagaatttggtgttgcctgtggtcttggtcccgcggagaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20100 - RNA, 1119 nt, synthetic construct
  misc_feature 1..1119: note = mRNA product Design f-5 comprising derived and/or modified sequence from HRSV(Memphis-37)__AIY60638.1__M (opt11)
  source 1..1119: mol_type = other RNA
gggagactttcccattctgtagcagaatttggtgttgcctgtggtcttggtcccgcggagaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20101 - RNA, 1115 nt, synthetic construct
  misc_feature 1..1115: note = mRNA product Design g-1 comprising derived and/or modified sequence from HRSV(Memphis-37)__AIY60638.1__M (wt)
  source 1..1115: mol_type = other RNA
gggagactttcccattctgtagcagaatttggtgttgcctgtggtcttggtcccgcggagaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20102 - RNA, 1115 nt, synthetic construct; identical to SEQ ID NO: 9942
  misc_feature 1..1115: note = mRNA product Design g-1 comprising derived and/or modified sequence from HRSV(Memphis-37)__AIY60638.1__M (opt1)
  source 1..1115: mol_type = other RNA

SEQ ID NO: 20103 - RNA, 1115 nt, synthetic construct; identical to SEQ ID NO: 9943
  misc_feature 1..1115: note = mRNA product Design g-1 comprising derived and/or modified sequence from HRSV(Memphis-37)__AIY60638.1__M (opt2)
  source 1..1115: mol_type = other RNA

SEQ ID NO: 20104 - RNA, 1115 nt, synthetic construct; identical to SEQ ID NO: 9944
  misc_feature 1..1115: note = mRNA product Design g-1 comprising derived and/or modified sequence from HRSV(Memphis-37)__AIY60638.1__M (opt3)
  source 1..1115: mol_type = other RNA

SEQ ID NO: 20105 - RNA, 1115 nt, synthetic construct; identical to SEQ ID NO: 9945
  misc_feature 1..1115: note = mRNA product Design g-1 comprising derived and/or modified sequence from HRSV(Memphis-37)__AIY60638.1__M (opt4)
  source 1..1115: mol_type = other RNA

SEQ ID NO: 20106 - RNA, 1115 nt, synthetic construct; identical to SEQ ID NO: 9946
  misc_feature 1..1115: note = mRNA product Design g-1 comprising derived and/or modified sequence from HRSV(Memphis-37)__AIY60638.1__M (opt5)
  source 1..1115: mol_type = other RNA

SEQ ID NO: 20107 - RNA, 1115 nt, synthetic construct
  misc_feature 1..1115: note = mRNA product Design g-1 comprising derived and/or modified sequence from HRSV(Memphis-37)__AIY60638.1__M (opt6)
  source 1..1115: mol_type = other RNA
gggagactttcccattctgtagcagaatttggtgttgcctgtggtcttggtcccgcggagaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20108 - RNA, 1115 nt, synthetic construct
  misc_feature 1..1115: note = mRNA product Design g-1 comprising derived and/or modified sequence from HRSV(Memphis-37)__AIY60638.1__M (opt11)
  source 1..1115: mol_type = other RNA
gggagactttcccattctgtagcagaatttggtgttgcctgtggtcttggtcccgcggagaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20109 - RNA, 1130 nt, synthetic construct
  misc_feature 1..1130: note = mRNA product Design g-2 comprising derived and/or modified sequence from HRSV(Memphis-37)__AIY60638.1__M (wt)
  source 1..1130: mol_type = other RNA
gggagagtccgctcagccaggttgcagaagcggcttagcgtgtgtcctaatcttctctctgcgtgtaggtaggcctgtgccgcaaacaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20110 - RNA, 1130 nt, synthetic construct; identical to SEQ ID NO: 9950
  misc_feature 1..1130: note = mRNA product Design g-2 comprising derived and/or modified sequence from HRSV(Memphis-37)__AIY60638.1__M (opt1)
  source 1..1130: mol_type = other RNA

SEQ ID NO: 20111 - RNA, 1130 nt, synthetic construct; identical to SEQ ID NO: 9951
  misc_feature 1..1130: note = mRNA product Design g-2 comprising derived and/or modified sequence from HRSV(Memphis-37)__AIY60638.1__M (opt2)
  source 1..1130: mol_type = other RNA

SEQ ID NO: 20112 - RNA, 1130 nt, synthetic construct; identical to SEQ ID NO: 9952
  misc_feature 1..1130: note = mRNA product Design g-2 comprising derived and/or modified sequence from HRSV(Memphis-37)__AIY60638.1__M (opt3)
  source 1..1130: mol_type = other RNA

SEQ ID NO: 20113 - RNA, 1130 nt, synthetic construct; identical to SEQ ID NO: 9953
  misc_feature 1..1130: note = mRNA product Design g-2 comprising derived and/or modified sequence from HRSV(Memphis-37)__AIY60638.1__M (opt4)
  source 1..1130: mol_type = other RNA

SEQ ID NO: 20114 - RNA, 1130 nt, synthetic construct; identical to SEQ ID NO: 9954
  misc_feature 1..1130: note = mRNA product Design g-2 comprising derived and/or modified sequence from HRSV(Memphis-37)__AIY60638.1__M (opt5)
  source 1..1130: mol_type = other RNA

SEQ ID NO: 20115 - RNA, 1130 nt, synthetic construct
  misc_feature 1..1130: note = mRNA product Design g-2 comprising derived and/or modified sequence from HRSV(Memphis-37)__AIY60638.1__M (opt6)
  source 1..1130: mol_type = other RNA
gggagagtccgctcagccaggttgcagaagcggcttagcgtgtgtcctaatcttctctctgcgtgtaggtaggcctgtgccgcaaacaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20116 - RNA, 1130 nt, synthetic construct
  misc_feature 1..1130: note = mRNA product Design g-2 comprising derived and/or modified sequence from HRSV(Memphis-37)__AIY60638.1__M (opt11)
  source 1..1130: mol_type = other RNA
gggagagtccgctcagccaggttgcagaagcggcttagcgtgtgtcctaatcttctctctgcgtgtaggtaggcctgtgccgcaaacaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20117 - RNA, 1362 nt, synthetic construct
  misc_feature 1..1362: note = mRNA product Design g-3 comprising derived and/or modified sequence from HRSV(Memphis-37)__AIY60638.1__M (wt)
  source 1..1362: mol_type = other RNA
gggagagtccgctcagccaggttgcagaagcggcttagcgtgtgtcctaatcttctctctgcgtgtaggtaggcctgtgccgcaaacaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20118 - RNA, 1362 nt, synthetic construct; identical to SEQ ID NO: 9958
  misc_feature 1..1362: note = mRNA product Design g-3 comprising derived and/or modified sequence from HRSV(Memphis-37)__AIY60638.1__M (opt1)
  source 1..1362: mol_type = other RNA

SEQ ID NO: 20119 - RNA, 1362 nt, synthetic construct; identical to SEQ ID NO: 9959
  misc_feature 1..1362: note = mRNA product Design g-3 comprising derived and/or modified sequence from HRSV(Memphis-37)__AIY60638.1__M (opt2)
  source 1..1362: mol_type = other RNA

SEQ ID NO: 20120 - RNA, 1362 nt, synthetic construct; identical to SEQ ID NO: 9960
  misc_feature 1..1362: note = mRNA product Design g-3 comprising derived and/or modified sequence from HRSV(Memphis-37)__AIY60638.1__M (opt3)
  source 1..1362: mol_type = other RNA

SEQ ID NO: 20121 - RNA, 1362 nt, synthetic construct; identical to SEQ ID NO: 9961
  misc_feature 1..1362: note = mRNA product Design g-3 comprising derived and/or modified sequence from HRSV(Memphis-37)__AIY60638.1__M (opt4)
  source 1..1362: mol_type = other RNA

SEQ ID NO: 20122 - RNA, 1362 nt, synthetic construct; identical to SEQ ID NO: 9962
  misc_feature 1..1362: note = mRNA product Design g-3 comprising derived and/or modified sequence from HRSV(Memphis-37)__AIY60638.1__M (opt5)
  source 1..1362: mol_type = other RNA

SEQ ID NO: 20123 - RNA, 1362 nt, synthetic construct
  misc_feature 1..1362: note = mRNA product Design g-3 comprising derived and/or modified sequence from HRSV(Memphis-37)__AIY60638.1__M (opt6)
  source 1..1362: mol_type = other RNA
gggagagtccgctcagccaggttgcagaagcggcttagcgtgtgtcctaatcttctctctgcgtgtaggtaggcctgtgccgcaaacaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20124 - RNA, 1362 nt, synthetic construct
  misc_feature 1..1362: note = mRNA product Design g-3 comprising derived and/or modified sequence from HRSV(Memphis-37)__AIY60638.1__M (opt11)
  source 1..1362: mol_type = other RNA
gggagagtccgctcagccaggttgcagaagcggcttagcgtgtgtcctaatcttctctctgcgtgtaggtaggcctgtgccgcaaacaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20125 - RNA, 1157 nt, synthetic construct
  misc_feature 1..1157: note = mRNA product Design g-4 comprising derived and/or modified sequence from HRSV(Memphis-37)__AIY60638.1__M (wt)
  source 1..1157: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20126 - RNA, 1157 nt, synthetic construct; identical to SEQ ID NO: 9966
  misc_feature 1..1157: note = mRNA product Design g-4 comprising derived and/or modified sequence from HRSV(Memphis-37)__AIY60638.1__M (opt1)
  source 1..1157: mol_type = other RNA

SEQ ID NO: 20127 - RNA, 1157 nt, synthetic construct; identical to SEQ ID NO: 9967
  misc_feature 1..1157: note = mRNA product Design g-4 comprising derived and/or modified sequence from HRSV(Memphis-37)__AIY60638.1__M (opt2)
  source 1..1157: mol_type = other RNA

SEQ ID NO: 20128 - RNA, 1157 nt, synthetic construct; identical to SEQ ID NO: 9968
  misc_feature 1..1157: note = mRNA product Design g-4 comprising derived and/or modified sequence from HRSV(Memphis-37)__AIY60638.1__M (opt3)
  source 1..1157: mol_type = other RNA

SEQ ID NO: 20129 - RNA, 1157 nt, synthetic construct; identical to SEQ ID NO: 9969
  misc_feature 1..1157: note = mRNA product Design g-4 comprising derived and/or modified sequence from HRSV(Memphis-37)__AIY60638.1__M (opt4)
  source 1..1157: mol_type = other RNA

SEQ ID NO: 20130 - RNA, 1157 nt, synthetic construct; identical to SEQ ID NO: 9970
  misc_feature 1..1157: note = mRNA product Design g-4 comprising derived and/or modified sequence from HRSV(Memphis-37)__AIY60638.1__M (opt5)
  source 1..1157: mol_type = other RNA

SEQ ID NO: 20131 - RNA, 1157 nt, synthetic construct
  misc_feature 1..1157: note = mRNA product Design g-4 comprising derived and/or modified sequence from HRSV(Memphis-37)__AIY60638.1__M (opt6)
  source 1..1157: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20132 - RNA, 1157 nt, synthetic construct
  misc_feature 1..1157: note = mRNA product Design g-4 comprising derived and/or modified sequence from HRSV(Memphis-37)__AIY60638.1__M (opt11)
  source 1..1157: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20133 - RNA, 1133 nt, synthetic construct
  misc_feature 1..1133: note = mRNA product Design g-5 comprising derived and/or modified sequence from HRSV(Memphis-37)__AIY60638.1__M (wt)
  source 1..1133: mol_type = other RNA
gggagacccgtgacccggaagttgtacggctacgcgactttccctcccacaaaccctcgcgcccttcctttcctacttgggcccggcagaaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20134 - RNA, 1133 nt, synthetic construct; identical to SEQ ID NO: 9974
  misc_feature 1..1133: note = mRNA product Design g-5 comprising derived and/or modified sequence from HRSV(Memphis-37)__AIY60638.1__M (opt1)
  source 1..1133: mol_type = other RNA

SEQ ID NO: 20135 - RNA, 1133 nt, synthetic construct; identical to SEQ ID NO: 9975
  misc_feature 1..1133: note = mRNA product Design g-5 comprising derived and/or modified sequence from HRSV(Memphis-37)__AIY60638.1__M (opt2)
  source 1..1133: mol_type = other RNA

SEQ ID NO: 20136 - RNA, 1133 nt, synthetic construct; identical to SEQ ID NO: 9976
  misc_feature 1..1133: note = mRNA product Design g-5 comprising derived and/or modified sequence from HRSV(Memphis-37)__AIY60638.1__M (opt3)
  source 1..1133: mol_type = other RNA

SEQ ID NO: 20137 - RNA, 1133 nt, synthetic construct; identical to SEQ ID NO: 9977
  misc_feature 1..1133: note = mRNA product Design g-5 comprising derived and/or modified sequence from HRSV(Memphis-37)__AIY60638.1__M (opt4)
  source 1..1133: mol_type = other RNA

SEQ ID NO: 20138 - RNA, 1133 nt, synthetic construct; identical to SEQ ID NO: 9978
  misc_feature 1..1133: note = mRNA product Design g-5 comprising derived and/or modified sequence from HRSV(Memphis-37)__AIY60638.1__M (opt5)
  source 1..1133: mol_type = other RNA

SEQ ID NO: 20139 - RNA, 1133 nt, synthetic construct
  misc_feature 1..1133: note = mRNA product Design g-5 comprising derived and/or modified sequence from HRSV(Memphis-37)__AIY60638.1__M (opt6)
  source 1..1133: mol_type = other RNA
gggagacccgtgacccggaagttgtacggctacgcgactttccctcccacaaaccctcgcgcccttcctttcctacttgggcccggcagaaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20140 - RNA, 1133 nt, synthetic construct
  misc_feature 1..1133: note = mRNA product Design g-5 comprising derived and/or modified sequence from HRSV(Memphis-37)__AIY60638.1__M (opt11)
  source 1..1133: mol_type = other RNA
gggagacccgtgacccggaagttgtacggctacgcgactttccctcccacaaaccctcgcgcccttcctttcctacttgggcccggcagaaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20141 - RNA, 1149 nt, synthetic construct
  misc_feature 1..1149: note = mRNA product Design h-1 comprising derived and/or modified sequence from HRSV(Memphis-37)__AIY60638.1__M (wt)
  source 1..1149: mol_type = other RNA
gggagacccgtgacccggaagttgtacggctacgcgactttccctcccacaaaccctcgcgcccttcctttcctacttgggcccggcagaaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20142 - RNA, 1149 nt, synthetic construct; identical to SEQ ID NO: 9982
  misc_feature 1..1149: note = mRNA product Design h-1 comprising derived and/or modified sequence from HRSV(Memphis-37)__AIY60638.1__M (opt1)
  source 1..1149: mol_type = other RNA

SEQ ID NO: 20143 - RNA, 1149 nt, synthetic construct; identical to SEQ ID NO: 9983
  misc_feature 1..1149: note = mRNA product Design h-1 comprising derived and/or modified sequence from HRSV(Memphis-37)__AIY60638.1__M (opt2)
  source 1..1149: mol_type = other RNA

SEQ ID NO: 20144 - RNA, 1149 nt, synthetic construct; identical to SEQ ID NO: 9984
  misc_feature 1..1149: note = mRNA product Design h-1 comprising derived and/or modified sequence from HRSV(Memphis-37)__AIY60638.1__M (opt3)
  source 1..1149: mol_type = other RNA

SEQ ID NO: 20145 - RNA, 1149 nt, synthetic construct; identical to SEQ ID NO: 9985
  misc_feature 1..1149: note = mRNA product Design h-1 comprising derived and/or modified sequence from HRSV(Memphis-37)__AIY60638.1__M (opt4)
  source 1..1149: mol_type = other RNA

SEQ ID NO: 20146 - RNA, 1149 nt, synthetic construct; identical to SEQ ID NO: 9986
  misc_feature 1..1149: note = mRNA product Design h-1 comprising derived and/or modified sequence from HRSV(Memphis-37)__AIY60638.1__M (opt5)
  source 1..1149: mol_type = other RNA

SEQ ID NO: 20147 - RNA, 1149 nt, synthetic construct
  misc_feature 1..1149: note = mRNA product Design h-1 comprising derived and/or modified sequence from HRSV(Memphis-37)__AIY60638.1__M (opt6)
  source 1..1149: mol_type = other RNA
gggagacccgtgacccggaagttgtacggctacgcgactttccctcccacaaaccctcgcgcccttcctttcctacttgggcccggcagaaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20148 - RNA, 1149 nt, synthetic construct
  misc_feature 1..1149: note = mRNA product Design h-1 comprising derived and/or modified sequence from HRSV(Memphis-37)__AIY60638.1__M (opt11)
  source 1..1149: mol_type = other RNA
gggagacccgtgacccggaagttgtacggctacgcgactttccctcccacaaaccctcgcgcccttcctttcctacttgggcccggcagaaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20149 - RNA, 1365 nt, synthetic construct
  misc_feature 1..1365: note = mRNA product Design h-2 comprising derived and/or modified sequence from HRSV(Memphis-37)__AIY60638.1__M (wt)
  source 1..1365: mol_type = other RNA
gggagacccgtgacccggaagttgtacggctacgcgactttccctcccacaaaccctcgcgcccttcctttcctacttgggcccggcagaaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20150 - RNA, 1365 nt, synthetic construct; identical to SEQ ID NO: 9990
  misc_feature 1..1365: note = mRNA product Design h-2 comprising derived and/or modified sequence from HRSV(Memphis-37)__AIY60638.1__M (opt1)
  source 1..1365: mol_type = other RNA

SEQ ID NO: 20151 - RNA, 1365 nt, synthetic construct; identical to SEQ ID NO: 9991
  misc_feature 1..1365: note = mRNA product Design h-2 comprising derived and/or modified sequence from HRSV(Memphis-37)__AIY60638.1__M (opt2)
  source 1..1365: mol_type = other RNA

SEQ ID NO: 20152 - RNA, 1365 nt, synthetic construct; identical to SEQ ID NO: 9992
  misc_feature 1..1365: note = mRNA product Design h-2 comprising derived and/or modified sequence from HRSV(Memphis-37)__AIY60638.1__M (opt3)
  source 1..1365: mol_type = other RNA

SEQ ID NO: 20153 - RNA, 1365 nt, synthetic construct; identical to SEQ ID NO: 9993
  misc_feature 1..1365: note = mRNA product Design h-2 comprising derived and/or modified sequence from HRSV(Memphis-37)__AIY60638.1__M (opt4)
  source 1..1365: mol_type = other RNA

SEQ ID NO: 20154 - RNA, 1365 nt, synthetic construct; identical to SEQ ID NO: 9994
  misc_feature 1..1365: note = mRNA product Design h-2 comprising derived and/or modified sequence from HRSV(Memphis-37)__AIY60638.1__M (opt5)
  source 1..1365: mol_type = other RNA

SEQ ID NO: 20155 - RNA, 1365 nt, synthetic construct
  misc_feature 1..1365: note = mRNA product Design h-2 comprising derived and/or modified sequence from HRSV(Memphis-37)__AIY60638.1__M (opt6)
  source 1..1365: mol_type = other RNA
gggagacccgtgacccggaagttgtacggctacgcgactttccctcccacaaaccctcgcgcccttcctttcctacttgggcccggcagaaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20156 - RNA, 1365 nt, synthetic construct
  misc_feature 1..1365: note = mRNA product Design h-2 comprising derived and/or modified sequence from HRSV(Memphis-37)__AIY60638.1__M (opt11)
  source 1..1365: mol_type = other RNA
gggagacccgtgacccggaagttgtacggctacgcgactttccctcccacaaaccctcgcgcccttcctttcctacttgggcccggcagaaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20157 - RNA, 1145 nt, synthetic construct
  misc_feature 1..1145: note = mRNA product Design h-3 comprising derived and/or modified sequence from HRSV(Memphis-37)__AIY60638.1__M (wt)
  source 1..1145: mol_type = other RNA
gggagacccgtgacccggaagttgtacggctacgcgactttccctcccacaaaccctcgcgcccttcctttcctacttgggcccggcagaaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20158 - RNA, 1145 nt, synthetic construct; identical to SEQ ID NO: 9998
  misc_feature 1..1145: note = mRNA product Design h-3 comprising derived and/or modified sequence from HRSV(Memphis-37)__AIY60638.1__M (opt1)
  source 1..1145: mol_type = other RNA

SEQ ID NO: 20159 - RNA, 1145 nt, synthetic construct; identical to SEQ ID NO: 9999
  misc_feature 1..1145: note = mRNA product Design h-3 comprising derived and/or modified sequence from HRSV(Memphis-37)__AIY60638.1__M (opt2)
  source 1..1145: mol_type = other RNA

SEQ ID NO: 20160 - RNA, 1145 nt, synthetic construct; identical to SEQ ID NO: 10000
  misc_feature 1..1145: note = mRNA product Design h-3 comprising derived and/or modified sequence from HRSV(Memphis-37)__AIY60638.1__M (opt3)
  source 1..1145: mol_type = other RNA

SEQ ID NO: 20161 - RNA, 1145 nt, synthetic construct; identical to SEQ ID NO: 10001
  misc_feature 1..1145: note = mRNA product Design h-3 comprising derived and/or modified sequence from HRSV(Memphis-37)__AIY60638.1__M (opt4)
  source 1..1145: mol_type = other RNA

SEQ ID NO: 20162 - RNA, 1145 nt, synthetic construct; identical to SEQ ID NO: 10002
  misc_feature 1..1145: note = mRNA product Design h-3 comprising derived and/or modified sequence from HRSV(Memphis-37)__AIY60638.1__M (opt5)
  source 1..1145: mol_type = other RNA

SEQ ID NO: 20163 - RNA, 1145 nt, synthetic construct
  misc_feature 1..1145: note = mRNA product Design h-3 comprising derived and/or modified sequence from HRSV(Memphis-37)__AIY60638.1__M (opt6)
  source 1..1145: mol_type = other RNA
gggagacccgtgacccggaagttgtacggctacgcgactttccctcccacaaaccctcgcgcccttcctttcctacttgggcccggcagaaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20164 - RNA, 1145 nt, synthetic construct
  misc_feature 1..1145: note = mRNA product Design h-3 comprising derived and/or modified sequence from HRSV(Memphis-37)__AIY60638.1__M (opt11)
  source 1..1145: mol_type = other RNA
gggagacccgtgacccggaagttgtacggctacgcgactttccctcccacaaaccctcgcgcccttcctttcctacttgggcccggcagaaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20165 - RNA, 1208 nt, synthetic construct
  misc_feature 1..1208: note = mRNA product Design h-4 comprising derived and/or modified sequence from HRSV(Memphis-37)__AIY60638.1__M (wt)
  source 1..1208: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20166 - RNA, 1208 nt, synthetic construct; identical to SEQ ID NO: 10006
  misc_feature 1..1208: note = mRNA product Design h-4 comprising derived and/or modified sequence from HRSV(Memphis-37)__AIY60638.1__M (opt1)
  source 1..1208: mol_type = other RNA

SEQ ID NO: 20167 - RNA, 1208 nt, synthetic construct; identical to SEQ ID NO: 10007
  misc_feature 1..1208: note = mRNA product Design h-4 comprising derived and/or modified sequence from HRSV(Memphis-37)__AIY60638.1__M (opt2)
  source 1..1208: mol_type = other RNA

SEQ ID NO: 20168 - RNA, 1208 nt, synthetic construct; identical to SEQ ID NO: 10008
  misc_feature 1..1208: note = mRNA product Design h-4 comprising derived and/or modified sequence from HRSV(Memphis-37)__AIY60638.1__M (opt3)
  source 1..1208: mol_type = other RNA

SEQ ID NO: 20169 - RNA, 1208 nt, synthetic construct; identical to SEQ ID NO: 10009
  misc_feature 1..1208: note = mRNA product Design h-4 comprising derived and/or modified sequence from HRSV(Memphis-37)__AIY60638.1__M (opt4)
  source 1..1208: mol_type = other RNA

SEQ ID NO: 20170 - RNA, 1208 nt, synthetic construct; identical to SEQ ID NO: 10010
  misc_feature 1..1208: note = mRNA product Design h-4 comprising derived and/or modified sequence from HRSV(Memphis-37)__AIY60638.1__M (opt5)
  source 1..1208: mol_type = other RNA

SEQ ID NO: 20171 - RNA, 1208 nt, synthetic construct
  misc_feature 1..1208: note = mRNA product Design h-4 comprising derived and/or modified sequence from HRSV(Memphis-37)__AIY60638.1__M (opt6)
  source 1..1208: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20172 - RNA, 1208 nt, synthetic construct
  misc_feature 1..1208: note = mRNA product Design h-4 comprising derived and/or modified sequence from HRSV(Memphis-37)__AIY60638.1__M (opt11)
  source 1..1208: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20173 - RNA, 1224 nt, synthetic construct
  misc_feature 1..1224: note = mRNA product Design h-5 comprising derived and/or modified sequence from HRSV(Memphis-37)__AIY60638.1__M (wt)
  source 1..1224: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20174 - RNA, 1224 nt, synthetic construct; identical to SEQ ID NO: 10014
  misc_feature 1..1224: note = mRNA product Design h-5 comprising derived and/or modified sequence from HRSV(Memphis-37)__AIY60638.1__M (opt1)
  source 1..1224: mol_type = other RNA

SEQ ID NO: 20175 - RNA, 1224 nt, synthetic construct; identical to SEQ ID NO: 10015
  misc_feature 1..1224: note = mRNA product Design h-5 comprising derived and/or modified sequence from HRSV(Memphis-37)__AIY60638.1__M (opt2)
  source 1..1224: mol_type = other RNA

SEQ ID NO: 20176 - RNA, 1224 nt, synthetic construct; identical to SEQ ID NO: 10016
  misc_feature 1..1224: note = mRNA product Design h-5 comprising derived and/or modified sequence from HRSV(Memphis-37)__AIY60638.1__M (opt3)
  source 1..1224: mol_type = other RNA

SEQ ID NO: 20177 - RNA, 1224 nt, synthetic construct; identical to SEQ ID NO: 10017
  misc_feature 1..1224: note = mRNA product Design h-5 comprising derived and/or modified sequence from HRSV(Memphis-37)__AIY60638.1__M (opt4)
  source 1..1224: mol_type = other RNA

SEQ ID NO: 20178 - RNA, 1224 nt, synthetic construct; identical to SEQ ID NO: 10018
  misc_feature 1..1224: note = mRNA product Design h-5 comprising derived and/or modified sequence from HRSV(Memphis-37)__AIY60638.1__M (opt5)
  source 1..1224: mol_type = other RNA

SEQ ID NO: 20179 - RNA, 1224 nt, synthetic construct
  misc_feature 1..1224: note = mRNA product Design h-5 comprising derived and/or modified sequence from HRSV(Memphis-37)__AIY60638.1__M (opt6)
  source 1..1224: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20180 - RNA, 1224 nt, synthetic construct
  misc_feature 1..1224: note = mRNA product Design h-5 comprising derived and/or modified sequence from HRSV(Memphis-37)__AIY60638.1__M (opt11)
  source 1..1224: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20181 - RNA, 1157 nt, synthetic construct
  misc_feature 1..1157: note = mRNA product Design i-1 comprising derived and/or modified sequence from HRSV(Memphis-37)__AIY60638.1__M (wt)
  source 1..1157: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20182 - RNA, 1157 nt, synthetic construct; identical to SEQ ID NO: 10022
  misc_feature 1..1157: note = mRNA product Design i-1 comprising derived and/or modified sequence from HRSV(Memphis-37)__AIY60638.1__M (opt1)
  source 1..1157: mol_type = other RNA

SEQ ID NO: 20183 - RNA, 1157 nt, synthetic construct; identical to SEQ ID NO: 10023
  misc_feature 1..1157: note = mRNA product Design i-1 comprising derived and/or modified sequence from HRSV(Memphis-37)__AIY60638.1__M (opt2)
  source 1..1157: mol_type = other RNA

SEQ ID NO: 20184 - RNA, 1157 nt, synthetic construct; identical to SEQ ID NO: 10024
  misc_feature 1..1157: note = mRNA product Design i-1 comprising derived and/or modified sequence from HRSV(Memphis-37)__AIY60638.1__M (opt3)
  source 1..1157: mol_type = other RNA

SEQ ID NO: 20185 - RNA, 1157 nt, synthetic construct; identical to SEQ ID NO: 10025
  misc_feature 1..1157: note = mRNA product Design i-1 comprising derived and/or modified sequence from HRSV(Memphis-37)__AIY60638.1__M (opt4)
  source 1..1157: mol_type = other RNA

SEQ ID NO: 20186 - RNA, 1157 nt, synthetic construct; identical to SEQ ID NO: 10026
  misc_feature 1..1157: note = mRNA product Design i-1 comprising derived and/or modified sequence from HRSV(Memphis-37)__AIY60638.1__M (opt5)
  source 1..1157: mol_type = other RNA

SEQ ID NO: 20187 - RNA, 1157 nt, synthetic construct
  misc_feature 1..1157: note = mRNA product Design i-1 comprising derived and/or modified sequence from HRSV(Memphis-37)__AIY60638.1__M (opt6)
  source 1..1157: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20188 - RNA, 1157 nt, synthetic construct
  misc_feature 1..1157: note = mRNA product Design i-1 comprising derived and/or modified sequence from HRSV(Memphis-37)__AIY60638.1__M (opt11)
  source 1..1157: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20189 - RNA, 1157 nt, synthetic construct
  misc_feature 1..1157: note = mRNA product Design i-2 comprising derived and/or modified sequence from HRSV(Memphis-37)__AIY60638.1__M (wt)
  source 1..1157: mol_type = other RNA
gggagaggcgctgcctacggaggtggcagccatctccttctcggcatcaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20190 - RNA, 1157 nt, synthetic construct; identical to SEQ ID NO: 10030
  misc_feature 1..1157: note = mRNA product Design i-2 comprising derived and/or modified sequence from HRSV(Memphis-37)__AIY60638.1__M (opt1)
  source 1..1157: mol_type = other RNA

SEQ ID NO: 20191 - RNA, 1157 nt, synthetic construct; identical to SEQ ID NO: 10031
  misc_feature 1..1157: note = mRNA product Design i-2 comprising derived and/or modified sequence from HRSV(Memphis-37)__AIY60638.1__M (opt2)
  source 1..1157: mol_type = other RNA

SEQ ID NO: 20192 - RNA, 1157 nt, synthetic construct; identical to SEQ ID NO: 10032
  misc_feature 1..1157: note = mRNA product Design i-2 comprising derived and/or modified sequence from HRSV(Memphis-37)__AIY60638.1__M (opt3)
  source 1..1157: mol_type = other RNA

SEQ ID NO: 20193 - RNA, 1157 nt, synthetic construct; identical to SEQ ID NO: 10033
  misc_feature 1..1157: note = mRNA product Design i-2 comprising derived and/or modified sequence from HRSV(Memphis-37)__AIY60638.1__M (opt4)
  source 1..1157: mol_type = other RNA

SEQ ID NO: 20194 - RNA, 1157 nt, synthetic construct; identical to SEQ ID NO: 10034
  misc_feature 1..1157: note = mRNA product Design i-2 comprising derived and/or modified sequence from HRSV(Memphis-37)__AIY60638.1__M (opt5)
  source 1..1157: mol_type = other RNA

SEQ ID NO: 20195 - RNA, 1157 nt, synthetic construct
  misc_feature 1..1157: note = mRNA product Design i-2 comprising derived and/or modified sequence from HRSV(Memphis-37)__AIY60638.1__M (opt6)
  source 1..1157: mol_type = other RNA
gggagaggcgctgcctacggaggtggcagccatctccttctcggcatcaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20196 - RNA, 1157 nt, synthetic construct
  misc_feature 1..1157: note = mRNA product Design i-2 comprising derived and/or modified sequence from HRSV(Memphis-37)__AIY60638.1__M (opt11)
  source 1..1157: mol_type = other RNA
gggagaggcgctgcctacggaggtggcagccatctccttctcggcatcaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20197 - RNA, 1153 nt, synthetic construct
  misc_feature 1..1153: note = mRNA product Design i-2 comprising derived and/or modified sequence from HRSV(Memphis-37)__AIY60638.1__M (wt)
  source 1..1153: mol_type = other RNA
ggggcgctgcctacggaggtggcagccatctccttctcggcatcaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20198 - RNA, 1153 nt, synthetic construct; identical to SEQ ID NO: 10038
  misc_feature 1..1153: note = mRNA product Design i-2 comprising derived and/or modified sequence from HRSV(Memphis-37)__AIY60638.1__M (opt1)
  source 1..1153: mol_type = other RNA

SEQ ID NO: 20199 - RNA, 1153 nt, synthetic construct; identical to SEQ ID NO: 10039
  misc_feature 1..1153: note = mRNA product Design i-2 comprising derived and/or modified sequence from HRSV(Memphis-37)__AIY60638.1__M (opt2)
  source 1..1153: mol_type = other RNA

SEQ ID NO: 20200 - RNA, 1153 nt, synthetic construct; identical to SEQ ID NO: 10040
  misc_feature 1..1153: note = mRNA product Design i-2 comprising derived and/or modified sequence from HRSV(Memphis-37)__AIY60638.1__M (opt3)
  source 1..1153: mol_type = other RNA

SEQ ID NO: 20201 - RNA, 1153 nt, synthetic construct; identical to SEQ ID NO: 10041
  misc_feature 1..1153: note = mRNA product Design i-2 comprising derived and/or modified sequence from HRSV(Memphis-37)__AIY60638.1__M (opt4)
  source 1..1153: mol_type = other RNA

SEQ ID NO: 20202 - RNA, 1153 nt, synthetic construct; identical to SEQ ID NO: 10042
  misc_feature 1..1153: note = mRNA product Design i-2 comprising derived and/or modified sequence from HRSV(Memphis-37)__AIY60638.1__M (opt5)
  source 1..1153: mol_type = other RNA

SEQ ID NO: 20203 - RNA, 1153 nt, synthetic construct
  misc_feature 1..1153: note = mRNA product Design i-2 comprising derived and/or modified sequence from HRSV(Memphis-37)__AIY60638.1__M (opt6)
  source 1..1153: mol_type = other RNA
ggggcgctgcctacggaggtggcagccatctccttctcggcatcaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20204 - RNA, 1153 nt, synthetic construct
  misc_feature 1..1153: note = mRNA product Design i-2 comprising derived and/or modified sequence from HRSV(Memphis-37)__AIY60638.1__M (opt11)
  source 1..1153: mol_type = other RNA
ggggcgctgcctacggaggtggcagccatctccttctcggcatcaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20205 - RNA, 988 nt, synthetic construct
  misc_feature 1..988: note = mRNA product Design i-3 comprising derived and/or modified sequence from HRSV(Memphis-37)__AIY60638.1__M (wt)
  source 1..988: mol_type = other RNA
gggagaaagcttaccatggaaacatacgtgaacaaacttcacgaaggctccacatacacagctgctgttcaatacaatgtcctagaaaaagacgatgaccctgcatcacttacaatatgggtgcccatgttccaatcatccatgccagcagatttacttataaaagaactagctaatgtcaacatactagtgaaacaaatatccacacccaaaggaccttcattaagagtcatgataaactcaagaagtgcagtgctagcacaaatgcccagcaaattcactatatgtgccaatgtgtccttggatgaaagaagcaagctggcatatgatgtaaccacaccctgcgaaatcaaggcatgtagtctaacatgcctaaaatcaaaaaatatgttaactacagttaaagatctcactatgaaaacactcaacccaacacatgacatcattgctttatgtgaatttgaaaatatagtaacatcaaaaaaagtcataataccaacatacttaagatccatcagtgtcagaaataaagatctgaacacacttgaaaatataacaaccaccgaattcaaaaatgccatcacaaatgcaaaaatcatcccttactcaggattactgttagtcatcacagtgactgacaacaaaggagcatttaaatacataaagccacaaagtcaattcatagtagatcttggagcttacctagaaaaagaaagtatatattatgttacaacaaattggaagcacacagctacacgatttgcaatcaaacccatggaagattaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20206 - RNA, 988 nt, synthetic construct; identical to SEQ ID NO: 10046
  misc_feature 1..988: note = mRNA product Design i-3 comprising derived and/or modified sequence from HRSV(Memphis-37)__AIY60638.1__M (opt1)
  source 1..988: mol_type = other RNA

SEQ ID NO: 20207 - RNA, 988 nt, synthetic construct; identical to SEQ ID NO: 10047
  misc_feature 1..988: note = mRNA product Design i-3 comprising derived and/or modified sequence from HRSV(Memphis-37)__AIY60638.1__M (opt2)
  source 1..988: mol_type = other RNA

SEQ ID NO: 20208 - RNA, 988 nt, synthetic construct; identical to SEQ ID NO: 10048
  misc_feature 1..988: note = mRNA product Design i-3 comprising derived and/or modified sequence from HRSV(Memphis-37)__AIY60638.1__M (opt3)
  source 1..988: mol_type = other RNA

SEQ ID NO: 20209 - RNA, 988 nt, synthetic construct; identical to SEQ ID NO: 10049
  misc_feature 1..988: note = mRNA product Design i-3 comprising derived and/or modified sequence from HRSV(Memphis-37)__AIY60638.1__M (opt4)
  source 1..988: mol_type = other RNA

SEQ ID NO: 20210 - RNA, 988 nt, synthetic construct; identical to SEQ ID NO: 10050
  misc_feature 1..988: note = mRNA product Design i-3 comprising derived and/or modified sequence from HRSV(Memphis-37)__AIY60638.1__M (opt5)
  source 1..988: mol_type = other RNA

SEQ ID NO: 20211 - RNA, 988 nt, synthetic construct
  misc_feature 1..988: note = mRNA product Design i-3 comprising derived and/or modified sequence from HRSV(Memphis-37)__AIY60638.1__M (opt6)
  source 1..988: mol_type = other RNA
gggagaaagcttaccatggaaacatatgtaaacaaattacacgaaggatccacttacacagccgcagtacaatacaatgtactagaaaaagacgacgacccagcatcactaacaatatgggtacccatgttccaatcctcaatgccagcagacctcctaataaaagaactagctaatgtaaacatactcgtaaaacaaatatccacaccaaaaggaccatcactacgagtaatgataaactccagatccgcagtactagcacaaatgccatcaaaattcacaatatgcgccaacgtatcactagacgaaagatcaaaattagcatacgacgtaacaacaccatgcgaaataaaagcatgctcactcacatgcttaaaatcaaaaaacatgctaacaacagtaaaagacctaacaatgaaaacactcaaccccacccacgacataattgccttatgcgaatttgaaaacatagtaacatccaaaaaagtaataataccaacatacctaagatccatttcagtaagaaacaaagacctaaacacactagaaaacataacaacaacagaatttaaaaacgcaataacaaacgcaaaaataataccatactcaggattactacttgtaataacagtaacagacaacaaaggagcattcaaatacataaaacctcaatcacaatttatagtagacctaggagcatacttagaaaaagaatcaatctattacgtcactacaaactggaaacacacagcaaccagattcgcaataaaacccatggaagactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20212 - RNA, 988 nt, synthetic construct
  misc_feature 1..988: note = mRNA product Design i-3 comprising derived and/or modified sequence from HRSV(Memphis-37)__AIY60638.1__M (opt11)
  source 1..988: mol_type = other RNA
gggagaaagcttaccatggaaacctacgtcaacaaactccacgaaggatccacctacaccgccgccgtccaatacaacgtccttgaaaaagacgacgaccccgcctccctcaccatctgggtccccatgttccaatcctcaatgcccgccgacctcctaatcaaagaactcgccaacgtcaacatcctcgtcaaacaaatctccacccccaaaggcccctccctccgagtcatgatcaactcccgctccgccgtcctcgcacaaatgccctccaaattcaccatctgcgccaacgtatccctcgacgaacgctccaaactcgcatacgacgttaccactccctgcgaaatcaaagcctgctcactcacctgcctcaaatccaaaaacatgctcaccaccgtcaaagacctcaccatgaaaaccctaaaccccacccacgacatcatcgccctctgcgaatttgaaaacatagtcacctccaaaaaagtaatcatccccacctacctccgctccatctccgtccgcaacaaagacctcaacacactcgaaaacatcacaaccaccgaatttaaaaacgccatcaccaacgccaaaatcatcccatactccggcctcctcctagtcatcaccgtcaccgacaacaaaggcgccttcaagtacatcaaaccacaatcccaattcatcgtcgacctcggcgcctacctcgaaaaagaatccatctactacgtaaccaccaactggaaacacaccgccacccgcttcgccatcaaacccatggaagactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20213 - protein, 391 aa, synthetic construct; identical to SEQ ID NO: 10503
  REGION 1..391: note = derived and/or modified protein sequence (wt) from HRSV(Memphis-37)__AIY60635.1__N

SEQ ID NO: 20214 - RNA, 1176 nt, synthetic construct
  misc_feature 1..1176: note = derived and/or modified CDS sequence (wt) from HRSV(Memphis-37)__AIY60635.1__N
  source 1..1176: mol_type = other RNA
atggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttga

SEQ ID NO: 20215 - RNA, 1176 nt, synthetic construct
  misc_feature 1..1176: note = derived and/or modified CDS sequence (opt1) from HRSV(Memphis-37)__AIY60635.1__N
  source 1..1176: mol_type = other RNA
atggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtga

SEQ ID NO: 20216 - RNA, 1176 nt, synthetic construct
  misc_feature 1..1176: note = derived and/or modified CDS sequence (opt2) from HRSV(Memphis-37)__AIY60635.1__N
  source 1..1176: mol_type = other RNA
atggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctga

SEQ ID NO: 20217 - RNA, 1176 nt, synthetic construct
  misc_feature 1..1176: note = derived and/or modified CDS sequence (opt3) from HRSV(Memphis-37)__AIY60635.1__N
  source 1..1176: mol_type = other RNA
atggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtga

SEQ ID NO: 20218 - RNA, 1176 nt, synthetic construct
  misc_feature 1..1176: note = derived and/or modified CDS sequence (opt4) from HRSV(Memphis-37)__AIY60635.1__N
  source 1..1176: mol_type = other RNA
atggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtga

SEQ ID NO: 20219 - RNA, 1176 nt, synthetic construct
  misc_feature 1..1176: note = derived and/or modified CDS sequence (opt5) from HRSV(Memphis-37)__AIY60635.1__N
  source 1..1176: mol_type = other RNA
atggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtga

SEQ ID NO: 20220 - RNA, 1176 nt, synthetic construct
  misc_feature 1..1176: note = derived and/or modified CDS sequence (opt6) from HRSV(Memphis-37)__AIY60635.1__N
  source 1..1176: mol_type = other RNA
atggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaa

SEQ ID NO: 20221 - RNA, 1176 nt, synthetic construct
  misc_feature 1..1176: note = derived and/or modified CDS sequence (opt11) from HRSV(Memphis-37)__AIY60635.1__N
  source 1..1176: mol_type = other RNA
atggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaa

SEQ ID NO: 20222 - RNA, 1452 nt, synthetic construct
  misc_feature 1..1452: note = mRNA product Design a-1 comprising derived and/or modified sequence from HRSV(Memphis-37)__AIY60635.1__N (wt)
  source 1..1452: mol_type = other RNA
gggagagtcccgcagtcggcgtccagcggctctgcttgttcgtgtgtgtgtcgttgcaggccttattcaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20223 - RNA, 1452 nt, synthetic construct
  misc_feature 1..1452: note = mRNA product Design a-1 comprising derived and/or modified sequence from HRSV(Memphis-37)__AIY60635.1__N (opt1)
  source 1..1452: mol_type = other RNA
gggagagtcccgcagtcggcgtccagcggctctgcttgttcgtgtgtgtgtcgttgcaggccttattcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20224 - RNA, 1452 nt, synthetic construct
  misc_feature 1..1452: note = mRNA product Design a-1 comprising derived and/or modified sequence from HRSV(Memphis-37)__AIY60635.1__N (opt2)
  source 1..1452: mol_type = other RNA
gggagagtcccgcagtcggcgtccagcggctctgcttgttcgtgtgtgtgtcgttgcaggccttattcaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20225 - RNA, 1452 nt, synthetic construct
  misc_feature 1..1452: note = mRNA product Design a-1 comprising derived and/or modified sequence from HRSV(Memphis-37)__AIY60635.1__N (opt3)
  source 1..1452: mol_type = other RNA
gggagagtcccgcagtcggcgtccagcggctctgcttgttcgtgtgtgtgtcgttgcaggccttattcaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20226 - RNA, 1452 nt, synthetic construct
  misc_feature 1..1452: note = mRNA product Design a-1 comprising derived and/or modified sequence from HRSV(Memphis-37)__AIY60635.1__N (opt4)
  source 1..1452: mol_type = other RNA
gggagagtcccgcagtcggcgtccagcggctctgcttgttcgtgtgtgtgtcgttgcaggccttattcaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20227 - RNA, 1452 nt, synthetic construct
  misc_feature 1..1452: note = mRNA product Design a-1 comprising derived and/or modified sequence from HRSV(Memphis-37)__AIY60635.1__N (opt5)
  source 1..1452: mol_type = other RNA
gggagagtcccgcagtcggcgtccagcggctctgcttgttcgtgtgtgtgtcgttgcaggccttattcaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20228 - RNA, 1452 nt, synthetic construct
  misc_feature 1..1452: note = mRNA product Design a-1 comprising derived and/or modified sequence from HRSV(Memphis-37)__AIY60635.1__N (opt6)
  source 1..1452: mol_type = other RNA
gggagagtcccgcagtcggcgtccagcggctctgcttgttcgtgtgtgtgtcgttgcaggccttattcaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20229 - RNA, 1452 nt, synthetic construct
  misc_feature 1..1452: note = mRNA product Design a-1 comprising derived and/or modified sequence from HRSV(Memphis-37)__AIY60635.1__N (opt11)
  source 1..1452: mol_type = other RNA
gggagagtcccgcagtcggcgtccagcggctctgcttgttcgtgtgtgtgtcgttgcaggccttattcaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20230 - RNA, 1471 nt, synthetic construct
  misc_feature 1..1471: note = mRNA product Design a-2 comprising derived and/or modified sequence from HRSV(Memphis-37)__AIY60635.1__N (wt)
  source 1..1471: mol_type = other RNA
gggagagtccgctcagccaggttgcagaagcggcttagcgtgtgtcctaatcttctctctgcgtgtaggtaggcctgtgccgcaaacaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20231 - RNA, 1471 nt, synthetic construct
  misc_feature 1..1471: note = mRNA product Design a-2 comprising derived and/or modified sequence from HRSV(Memphis-37)__AIY60635.1__N (opt1)
  source 1..1471: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20232 - RNA, 1471 nt, synthetic construct
  misc_feature 1..1471: note = mRNA product Design a-2 comprising derived and/or modified sequence from HRSV(Memphis-37)__AIY60635.1__N (opt2)
  source 1..1471: mol_type = other RNA
gggagagtccgctcagccaggttgcagaagcggcttagcgtgtgtcctaatcttctctctgcgtgtaggtaggcctgtgccgcaaacaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20233 - RNA, 1471 nt, synthetic construct
  misc_feature 1..1471: note = mRNA product Design a-2 comprising derived and/or modified sequence from HRSV(Memphis-37)__AIY60635.1__N (opt3)
  source 1..1471: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20234 - RNA, 1471 nt, synthetic construct
  misc_feature 1..1471: note = mRNA product Design a-2 comprising derived and/or modified sequence from HRSV(Memphis-37)__AIY60635.1__N (opt4)
  source 1..1471: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20235 - RNA, 1471 nt, synthetic construct
  misc_feature 1..1471: note = mRNA product Design a-2 comprising derived and/or modified sequence from HRSV(Memphis-37)__AIY60635.1__N (opt5)
  source 1..1471: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20236 - RNA, 1471 nt, synthetic construct
  misc_feature 1..1471: note = mRNA product Design a-2 comprising derived and/or modified sequence from HRSV(Memphis-37)__AIY60635.1__N (opt6)
  source 1..1471: mol_type = other RNA
gggagagtccgctcagccaggttgcagaagcggcttagcgtgtgtcctaatcttctctctgcgtgtaggtaggcctgtgccgcaaacaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20237 - RNA, 1471 nt, synthetic construct
  misc_feature 1..1471: note = mRNA product Design a-2 comprising derived and/or modified sequence from HRSV(Memphis-37)__AIY60635.1__N (opt11)
  source 1..1471: mol_type = other RNA
gggagagtccgctcagccaggttgcagaagcggcttagcgtgtgtcctaatcttctctctgcgtgtaggtaggcctgtgccgcaaacaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20238 - RNA, 1549 nt, synthetic construct
  misc_feature 1..1549: note = mRNA product Design a-3 comprising derived and/or modified sequence from HRSV(Memphis-37)__AIY60635.1__N (wt)
  source 1..1549: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20239 - RNA, 1549 nt, synthetic construct
  misc_feature 1..1549: note = mRNA product Design a-3 comprising derived and/or modified sequence from HRSV(Memphis-37)__AIY60635.1__N (opt1)
  source 1..1549: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20240 - RNA, 1549 nt, synthetic construct
  misc_feature 1..1549: note = mRNA product Design a-3 comprising derived and/or modified sequence from HRSV(Memphis-37)__AIY60635.1__N (opt2)
  source 1..1549: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20241 - RNA, 1549 nt, synthetic construct
  misc_feature 1..1549: note = mRNA product Design a-3 comprising derived and/or modified sequence from HRSV(Memphis-37)__AIY60635.1__N (opt3)
  source 1..1549: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20242 - RNA, 1549 nt, synthetic construct
  misc_feature 1..1549: note = mRNA product Design a-3 comprising derived and/or modified sequence from HRSV(Memphis-37)__AIY60635.1__N (opt4)
  source 1..1549: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20243 - RNA, 1549 nt, synthetic construct
  misc_feature 1..1549: note = mRNA product Design a-3 comprising derived and/or modified sequence from HRSV(Memphis-37)__AIY60635.1__N (opt5)
  source 1..1549: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20244 - RNA, 1549 nt, synthetic construct
  misc_feature 1..1549: note = mRNA product Design a-3 comprising derived and/or modified sequence from HRSV(Memphis-37)__AIY60635.1__N (opt6)
  source 1..1549: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20245 - RNA, 1549 nt, synthetic construct
  misc_feature 1..1549: note = mRNA product Design a-3 comprising derived and/or modified sequence from HRSV(Memphis-37)__AIY60635.1__N (opt11)
  source 1..1549: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20246 - RNA, 1498 nt, synthetic construct
  misc_feature 1..1498: note = mRNA product Design a-4 comprising derived and/or modified sequence from HRSV(Memphis-37)__AIY60635.1__N (wt)
  source 1..1498: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20247 - RNA, 1498 nt, synthetic construct
  misc_feature 1..1498: note = mRNA product Design a-4 comprising derived and/or modified sequence from HRSV(Memphis-37)__AIY60635.1__N (opt1)
  source 1..1498: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20248 - RNA, 1498 nt, synthetic construct
  misc_feature 1..1498: note = mRNA product Design a-4 comprising derived and/or modified sequence from HRSV(Memphis-37)__AIY60635.1__N (opt2)
  source 1..1498: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20249 - RNA, 1498 nt, synthetic construct
  misc_feature 1..1498: note = mRNA product Design a-4 comprising derived and/or modified sequence from HRSV(Memphis-37)__AIY60635.1__N (opt3)
  source 1..1498: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20250 - RNA, 1498 nt, synthetic construct
  misc_feature 1..1498: note = mRNA product Design a-4 comprising derived and/or modified sequence from HRSV(Memphis-37)__AIY60635.1__N (opt4)
  source 1..1498: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20251 - RNA, 1498 nt, synthetic construct
  misc_feature 1..1498: note = mRNA product Design a-4 comprising derived and/or modified sequence from HRSV(Memphis-37)__AIY60635.1__N (opt5)
  source 1..1498: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20252 - RNA, 1498 nt, synthetic construct
  misc_feature 1..1498: note = mRNA product Design a-4 comprising derived and/or modified sequence from HRSV(Memphis-37)__AIY60635.1__N (opt6)
  source 1..1498: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20253 - RNA, 1498 nt, synthetic construct
  misc_feature 1..1498: note = mRNA product Design a-4 comprising derived and/or modified sequence from HRSV(Memphis-37)__AIY60635.1__N (opt11)
  source 1..1498: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20254 - RNA, 1444 nt, synthetic construct
  misc_feature 1..1444: note = mRNA product Design a-5 comprising derived and/or modified sequence from HRSV(Memphis-37)__AIY60635.1__N (wt)
  source 1..1444: mol_type = other RNA
gggagactttcccattctgtagcagaatttggtgttgcctgtggtcttggtcccgcggagaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20255 - RNA, 1444 nt, synthetic construct
  misc_feature 1..1444: note = mRNA product Design a-5 comprising derived and/or modified sequence from HRSV(Memphis-37)__AIY60635.1__N (opt1)
  source 1..1444: mol_type = other RNA
gggagactttcccattctgtagcagaatttggtgttgcctgtggtcttggtcccgcggagaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20256 - RNA, 1444 nt, synthetic construct
  misc_feature 1..1444: note = mRNA product Design a-5 comprising derived and/or modified sequence from HRSV(Memphis-37)__AIY60635.1__N (opt2)
  source 1..1444: mol_type = other RNA
gggagactttcccattctgtagcagaatttggtgttgcctgtggtcttggtcccgcggagaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20257 - RNA, 1444 nt, synthetic construct
  misc_feature 1..1444: note = mRNA product Design a-5 comprising derived and/or modified sequence from HRSV(Memphis-37)__AIY60635.1__N (opt3)
  source 1..1444: mol_type = other RNA
gggagactttcccattctgtagcagaatttggtgttgcctgtggtcttggtcccgcggagaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20258 - RNA, 1444 nt, synthetic construct
  misc_feature 1..1444: note = mRNA product Design a-5 comprising derived and/or modified sequence from HRSV(Memphis-37)__AIY60635.1__N (opt4)
  source 1..1444: mol_type = other RNA
gggagactttcccattctgtagcagaatttggtgttgcctgtggtcttggtcccgcggagaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20259 - RNA, 1444 nt, synthetic construct
  misc_feature 1..1444: note = mRNA product Design a-5 comprising derived and/or modified sequence from HRSV(Memphis-37)__AIY60635.1__N (opt5)
  source 1..1444: mol_type = other RNA
gggagactttcccattctgtagcagaatttggtgttgcctgtggtcttggtcccgcggagaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20260 - RNA, 1444 nt, synthetic construct
  misc_feature 1..1444: note = mRNA product Design a-5 comprising derived and/or modified sequence from HRSV(Memphis-37)__AIY60635.1__N (opt6)
  source 1..1444: mol_type = other RNA
gggagactttcccattctgtagcagaatttggtgttgcctgtggtcttggtcccgcggagaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20261 - RNA, 1444 nt, synthetic construct
  misc_feature 1..1444: note = mRNA product Design a-5 comprising derived and/or modified sequence from HRSV(Memphis-37)__AIY60635.1__N (opt11)
  source 1..1444: mol_type = other RNA
gggagactttcccattctgtagcagaatttggtgttgcctgtggtcttggtcccgcggagaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20262 - RNA, 1625 nt, synthetic construct
  misc_feature 1..1625: note = mRNA product Design b-1 comprising derived and/or modified sequence from HRSV(Memphis-37)__AIY60635.1__N (wt)
  source 1..1625: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20263 - RNA, 1625 nt, synthetic construct
  misc_feature 1..1625: note = mRNA product Design b-1 comprising derived and/or modified sequence from HRSV(Memphis-37)__AIY60635.1__N (opt1)
  source 1..1625: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20264 - RNA, 1625 nt, synthetic construct
  misc_feature 1..1625: note = mRNA product Design b-1 comprising derived and/or modified sequence from HRSV(Memphis-37)__AIY60635.1__N (opt2)
  source 1..1625: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20265 - RNA, 1625 nt, synthetic construct
  misc_feature 1..1625: note = mRNA product Design b-1 comprising derived and/or modified sequence from HRSV(Memphis-37)__AIY60635.1__N (opt3)
  source 1..1625: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20266 - RNA, 1625 nt, synthetic construct
  misc_feature 1..1625: note = mRNA product Design b-1 comprising derived and/or modified sequence from HRSV(Memphis-37)__AIY60635.1__N (opt4)
  source 1..1625: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20267 - RNA, 1625 nt, synthetic construct
  misc_feature 1..1625: note = mRNA product Design b-1 comprising derived and/or modified sequence from HRSV(Memphis-37)__AIY60635.1__N (opt5)
  source 1..1625: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20268 - RNA, 1625 nt, synthetic construct
  misc_feature 1..1625: note = mRNA product Design b-1 comprising derived and/or modified sequence from HRSV(Memphis-37)__AIY60635.1__N (opt6)
  source 1..1625: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20269 - RNA, 1625 nt, synthetic construct
  misc_feature 1..1625: note = mRNA product Design b-1 comprising derived and/or modified sequence from HRSV(Memphis-37)__AIY60635.1__N (opt11)
  source 1..1625: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20270 - RNA, 1445 nt, synthetic construct
  misc_feature 1..1445: note = mRNA product Design b-2 comprising derived and/or modified sequence from HRSV(Memphis-37)__AIY60635.1__N (wt)
  source 1..1445: mol_type = other RNA
gggagagcctctgctggagtccggggagtggcgttggctgctagagcgaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20271 - RNA, 1445 nt, synthetic construct
  misc_feature 1..1445: note = mRNA product Design b-2 comprising derived and/or modified sequence from HRSV(Memphis-37)__AIY60635.1__N (opt1)
  source 1..1445: mol_type = other RNA
gggagagcctctgctggagtccggggagtggcgttggctgctagagcgaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20272 - RNA, 1445 nt, synthetic construct
  misc_feature 1..1445: note = mRNA product Design b-2 comprising derived and/or modified sequence from HRSV(Memphis-37)__AIY60635.1__N (opt2)
  source 1..1445: mol_type = other RNA
gggagagcctctgctggagtccggggagtggcgttggctgctagagcgaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20273 - RNA, 1445 nt, synthetic construct
  misc_feature 1..1445: note = mRNA product Design b-2 comprising derived and/or modified sequence from HRSV(Memphis-37)__AIY60635.1__N (opt3)
  source 1..1445: mol_type = other RNA
gggagagcctctgctggagtccggggagtggcgttggctgctagagcgaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20274 - RNA, 1445 nt, synthetic construct
  misc_feature 1..1445: note = mRNA product Design b-2 comprising derived and/or modified sequence from HRSV(Memphis-37)__AIY60635.1__N (opt4)
  source 1..1445: mol_type = other RNA
gggagagcctctgctggagtccggggagtggcgttggctgctagagcgaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20275 - RNA, 1445 nt, synthetic construct
  misc_feature 1..1445: note = mRNA product Design b-2 comprising derived and/or modified sequence from HRSV(Memphis-37)__AIY60635.1__N (opt5)
  source 1..1445: mol_type = other RNA
gggagagcctctgctggagtccggggagtggcgttggctgctagagcgaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20276 - RNA, 1445 nt, synthetic construct
  misc_feature 1..1445: note = mRNA product Design b-2 comprising derived and/or modified sequence from HRSV(Memphis-37)__AIY60635.1__N (opt6)
  source 1..1445: mol_type = other RNA
gggagagcctctgctggagtccggggagtggcgttggctgctagagcgaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20277 - RNA, 1445 nt, synthetic construct
  misc_feature 1..1445: note = mRNA product Design b-2 comprising derived and/or modified sequence from HRSV(Memphis-37)__AIY60635.1__N (opt11)
  source 1..1445: mol_type = other RNA
gggagagcctctgctggagtccggggagtggcgttggctgctagagcgaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20278 - RNA, 1465 nt, synthetic construct
  misc_feature 1..1465: note = mRNA product Design b-3 comprising derived and/or modified sequence from HRSV(Memphis-37)__AIY60635.1__N (wt)
  source 1..1465: mol_type = other RNA
gggagagtcccgcagtcggcgtccagcggctctgcttgttcgtgtgtgtgtcgttgcaggccttattcaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20279 - RNA, 1465 nt, synthetic construct
  misc_feature 1..1465: note = mRNA product Design b-3 comprising derived and/or modified sequence from HRSV(Memphis-37)__AIY60635.1__N (opt1)
  source 1..1465: mol_type = other RNA
gggagagtcccgcagtcggcgtccagcggctctgcttgttcgtgtgtgtgtcgttgcaggccttattcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20280 - RNA, 1465 nt, synthetic construct
  misc_feature 1..1465: note = mRNA product Design b-3 comprising derived and/or modified sequence from HRSV(Memphis-37)__AIY60635.1__N (opt2)
  source 1..1465: mol_type = other RNA
gggagagtcccgcagtcggcgtccagcggctctgcttgttcgtgtgtgtgtcgttgcaggccttattcaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20281 - RNA, 1465 nt, synthetic construct
  misc_feature 1..1465: note = mRNA product Design b-3 comprising derived and/or modified sequence from HRSV(Memphis-37)__AIY60635.1__N (opt3)
  source 1..1465: mol_type = other RNA
gggagagtcccgcagtcggcgtccagcggctctgcttgttcgtgtgtgtgtcgttgcaggccttattcaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20282 - RNA, 1465 nt, synthetic construct
  misc_feature 1..1465: note = mRNA product Design b-3 comprising derived and/or modified sequence from HRSV(Memphis-37)__AIY60635.1__N (opt4)
  source 1..1465: mol_type = other RNA
gggagagtcccgcagtcggcgtccagcggctctgcttgttcgtgtgtgtgtcgttgcaggccttattcaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20283 - RNA, 1465 nt, synthetic construct
  misc_feature 1..1465: note = mRNA product Design b-3 comprising derived and/or modified sequence from HRSV(Memphis-37)__AIY60635.1__N (opt5)
  source 1..1465: mol_type = other RNA
gggagagtcccgcagtcggcgtccagcggctctgcttgttcgtgtgtgtgtcgttgcaggccttattcaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20284 - RNA, 1465 nt, synthetic construct
  misc_feature 1..1465: note = mRNA product Design b-3 comprising derived and/or modified sequence from HRSV(Memphis-37)__AIY60635.1__N (opt6)
  source 1..1465: mol_type = other RNA
gggagagtcccgcagtcggcgtccagcggctctgcttgttcgtgtgtgtgtcgttgcaggccttattcaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20285 - RNA, 1465 nt, synthetic construct
  misc_feature 1..1465: note = mRNA product Design b-3 comprising derived and/or modified sequence from HRSV(Memphis-37)__AIY60635.1__N (opt11)
  source 1..1465: mol_type = other RNA
gggagagtcccgcagtcggcgtccagcggctctgcttgttcgtgtgtgtgtcgttgcaggccttattcaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20286 - RNA, 1516 nt, synthetic construct
  misc_feature 1..1516: note = mRNA product Design b-4 comprising derived and/or modified sequence from HRSV(Memphis-37)__AIY60635.1__N (wt)
  source 1..1516: mol_type = other RNA
gggagagtcccgcagtcggcgtccagcggctctgcttgttcgtgtgtgtgtcgttgcaggccttattcaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20287 - RNA, 1516 nt, synthetic construct
  misc_feature 1..1516: note = mRNA product Design b-4 comprising derived and/or modified sequence from HRSV(Memphis-37)__AIY60635.1__N (opt1)
  source 1..1516: mol_type = other RNA
gggagagtcccgcagtcggcgtccagcggctctgcttgttcgtgtgtgtgtcgttgcaggccttattcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20288 - RNA, 1516 nt, synthetic construct
  misc_feature 1..1516: note = mRNA product Design b-4 comprising derived and/or modified sequence from HRSV(Memphis-37)__AIY60635.1__N (opt2)
  source 1..1516: mol_type = other RNA
gggagagtcccgcagtcggcgtccagcggctctgcttgttcgtgtgtgtgtcgttgcaggccttattcaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20289 - RNA, 1516 nt, synthetic construct
  misc_feature 1..1516: note = mRNA product Design b-4 comprising derived and/or modified sequence from HRSV(Memphis-37)__AIY60635.1__N (opt3)
  source 1..1516: mol_type = other RNA
gggagagtcccgcagtcggcgtccagcggctctgcttgttcgtgtgtgtgtcgttgcaggccttattcaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20290 - RNA, 1516 nt, synthetic construct
  misc_feature 1..1516: note = mRNA product Design b-4 comprising derived and/or modified sequence from HRSV(Memphis-37)__AIY60635.1__N (opt4)
  source 1..1516: mol_type = other RNA
gggagagtcccgcagtcggcgtccagcggctctgcttgttcgtgtgtgtgtcgttgcaggccttattcaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20291 - RNA, 1516 nt, synthetic construct
  misc_feature 1..1516: note = mRNA product Design b-4 comprising derived and/or modified sequence from HRSV(Memphis-37)__AIY60635.1__N (opt5)
  source 1..1516: mol_type = other RNA
gggagagtcccgcagtcggcgtccagcggctctgcttgttcgtgtgtgtgtcgttgcaggccttattcaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20292 - RNA, 1516 nt, synthetic construct
  misc_feature 1..1516: note = mRNA product Design b-4 comprising derived and/or modified sequence from HRSV(Memphis-37)__AIY60635.1__N (opt6)
  source 1..1516: mol_type = other RNA
gggagagtcccgcagtcggcgtccagcggctctgcttgttcgtgtgtgtgtcgttgcaggccttattcaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20293 - RNA, 1516 nt, synthetic construct
  misc_feature 1..1516: note = mRNA product Design b-4 comprising derived and/or modified sequence from HRSV(Memphis-37)__AIY60635.1__N (opt11)
  source 1..1516: mol_type = other RNA
gggagagtcccgcagtcggcgtccagcggctctgcttgttcgtgtgtgtgtcgttgcaggccttattcaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20294 - RNA, 1578 nt, synthetic construct
  misc_feature 1..1578: note = mRNA product Design b-5 comprising derived and/or modified sequence from HRSV(Memphis-37)__AIY60635.1__N (wt)
  source 1..1578: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20295 - RNA, 1578 nt, synthetic construct
  misc_feature 1..1578: note = mRNA product Design b-5 comprising derived and/or modified sequence from HRSV(Memphis-37)__AIY60635.1__N (opt1)
  source 1..1578: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20296 - RNA, 1578 nt, synthetic construct
  misc_feature 1..1578: note = mRNA product Design b-5 comprising derived and/or modified sequence from HRSV(Memphis-37)__AIY60635.1__N (opt2)
  source 1..1578: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20297 - RNA, 1578 nt, synthetic construct
  misc_feature 1..1578: note = mRNA product Design b-5 comprising derived and/or modified sequence from HRSV(Memphis-37)__AIY60635.1__N (opt3)
  source 1..1578: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20298 - RNA, 1578 nt, synthetic construct
  misc_feature 1..1578: note = mRNA product Design b-5 comprising derived and/or modified sequence from HRSV(Memphis-37)__AIY60635.1__N (opt4)
  source 1..1578: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20299 - RNA, 1578 nt, synthetic construct
  misc_feature 1..1578: note = mRNA product Design b-5 comprising derived and/or modified sequence from HRSV(Memphis-37)__AIY60635.1__N (opt5)
  source 1..1578: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20300 - RNA, 1578 nt, synthetic construct
  misc_feature 1..1578: note = mRNA product Design b-5 comprising derived and/or modified sequence from HRSV(Memphis-37)__AIY60635.1__N (opt6)
  source 1..1578: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20301 - RNA, 1578 nt, synthetic construct
  misc_feature 1..1578: note = mRNA product Design b-5 comprising derived and/or modified sequence from HRSV(Memphis-37)__AIY60635.1__N (opt11)
  source 1..1578: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20302 - RNA, 1484 nt, synthetic construct
  misc_feature 1..1484: note = mRNA product Design c-1 comprising derived and/or modified sequence from HRSV(Memphis-37)__AIY60635.1__N (wt)
  source 1..1484: mol_type = other RNA
gggagagtccgctcagccaggttgcagaagcggcttagcgtgtgtcctaatcttctctctgcgtgtaggtaggcctgtgccgcaaacaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20303 - RNA, 1484 nt, synthetic construct
  misc_feature 1..1484: note = mRNA product Design c-1 comprising derived and/or modified sequence from HRSV(Memphis-37)__AIY60635.1__N (opt1)
  source 1..1484: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20304 - RNA, 1484 nt, synthetic construct
  misc_feature 1..1484: note = mRNA product Design c-1 comprising derived and/or modified sequence from HRSV(Memphis-37)__AIY60635.1__N (opt2)
  source 1..1484: mol_type = other RNA
gggagagtccgctcagccaggttgcagaagcggcttagcgtgtgtcctaatcttctctctgcgtgtaggtaggcctgtgccgcaaacaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20305 - RNA, 1484 nt, synthetic construct
  misc_feature 1..1484: note = mRNA product Design c-1 comprising derived and/or modified sequence from HRSV(Memphis-37)__AIY60635.1__N (opt3)
  source 1..1484: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20306 - RNA, 1484 nt, synthetic construct
  misc_feature 1..1484: note = mRNA product Design c-1 comprising derived and/or modified sequence from HRSV(Memphis-37)__AIY60635.1__N (opt4)
  source 1..1484: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20307 - RNA, 1484 nt, synthetic construct
  misc_feature 1..1484: note = mRNA product Design c-1 comprising derived and/or modified sequence from HRSV(Memphis-37)__AIY60635.1__N (opt5)
  source 1..1484: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20308 - RNA, 1484 nt, synthetic construct
  misc_feature 1..1484: note = mRNA product Design c-1 comprising derived and/or modified sequence from HRSV(Memphis-37)__AIY60635.1__N (opt6)
  source 1..1484: mol_type = other RNA
gggagagtccgctcagccaggttgcagaagcggcttagcgtgtgtcctaatcttctctctgcgtgtaggtaggcctgtgccgcaaacaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20309 - RNA, 1484 nt, synthetic construct
  misc_feature 1..1484: note = mRNA product Design c-1 comprising derived and/or modified sequence from HRSV(Memphis-37)__AIY60635.1__N (opt11)
  source 1..1484: mol_type = other RNA
gggagagtccgctcagccaggttgcagaagcggcttagcgtgtgtcctaatcttctctctgcgtgtaggtaggcctgtgccgcaaacaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20310 - RNA, 1574 nt, synthetic construct
  misc_feature 1..1574: note = mRNA product Design c-2 comprising derived and/or modified sequence from HRSV(Memphis-37)__AIY60635.1__N (wt)
  source 1..1574: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20311 - RNA, 1574 nt, synthetic construct
  misc_feature 1..1574: note = mRNA product Design c-2 comprising derived and/or modified sequence from HRSV(Memphis-37)__AIY60635.1__N (opt1)
  source 1..1574: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20312 - RNA, 1574 nt, synthetic construct
  misc_feature 1..1574: note = mRNA product Design c-2 comprising derived and/or modified sequence from HRSV(Memphis-37)__AIY60635.1__N (opt2)
  source 1..1574: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20313 - RNA, 1574 nt, synthetic construct
  misc_feature 1..1574: note = mRNA product Design c-2 comprising derived and/or modified sequence from HRSV(Memphis-37)__AIY60635.1__N (opt3)
  source 1..1574: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20314 - RNA, 1574 nt, synthetic construct
  misc_feature 1..1574: note = mRNA product Design c-2 comprising derived and/or modified sequence from HRSV(Memphis-37)__AIY60635.1__N (opt4)
  source 1..1574: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20315 - RNA, 1574 nt, synthetic construct
  misc_feature 1..1574: note = mRNA product Design c-2 comprising derived and/or modified sequence from HRSV(Memphis-37)__AIY60635.1__N (opt5)
  source 1..1574: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20316 - RNA, 1574 nt, synthetic construct
  misc_feature 1..1574: note = mRNA product Design c-2 comprising derived and/or modified sequence from HRSV(Memphis-37)__AIY60635.1__N (opt6)
  source 1..1574: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20317 - RNA, 1574 nt, synthetic construct
  misc_feature 1..1574: note = mRNA product Design c-2 comprising derived and/or modified sequence from HRSV(Memphis-37)__AIY60635.1__N (opt11)
  source 1..1574: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20318 - RNA, 1551 nt, synthetic construct
  misc_feature 1..1551: note = mRNA product Design c-3 comprising derived and/or modified sequence from HRSV(Memphis-37)__AIY60635.1__N (wt)
  source 1..1551: mol_type = other RNA
gggagagtccgctcagccaggttgcagaagcggcttagcgtgtgtcctaatcttctctctgcgtgtaggtaggcctgtgccgcaaacaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20319 - RNA, 1551 nt, synthetic construct
  misc_feature 1..1551: note = mRNA product Design c-3 comprising derived and/or modified sequence from HRSV(Memphis-37)__AIY60635.1__N (opt1)
  source 1..1551: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20320 - RNA, 1551 nt, synthetic construct
  misc_feature 1..1551: note = mRNA product Design c-3 comprising derived and/or modified sequence from HRSV(Memphis-37)__AIY60635.1__N (opt2)
  source 1..1551: mol_type = other RNA
gggagagtccgctcagccaggttgcagaagcggcttagcgtgtgtcctaatcttctctctgcgtgtaggtaggcctgtgccgcaaacaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20321 - RNA, 1551 nt, synthetic construct
  misc_feature 1..1551: note = mRNA product Design c-3 comprising derived and/or modified sequence from HRSV(Memphis-37)__AIY60635.1__N (opt3)
  source 1..1551: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20322 - RNA, 1551 nt, synthetic construct
  misc_feature 1..1551: note = mRNA product Design c-3 comprising derived and/or modified sequence from HRSV(Memphis-37)__AIY60635.1__N (opt4)
  source 1..1551: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20323 - RNA, 1551 nt, synthetic construct
  misc_feature 1..1551: note = mRNA product Design c-3 comprising derived and/or modified sequence from HRSV(Memphis-37)__AIY60635.1__N (opt5)
  source 1..1551: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20324 - RNA, 1551 nt, synthetic construct
  misc_feature 1..1551: note = mRNA product Design c-3 comprising derived and/or modified sequence from HRSV(Memphis-37)__AIY60635.1__N (opt6)
  source 1..1551: mol_type = other RNA
gggagagtccgctcagccaggttgcagaagcggcttagcgtgtgtcctaatcttctctctgcgtgtaggtaggcctgtgccgcaaacaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20325 - RNA, 1551 nt, synthetic construct
  misc_feature 1..1551: note = mRNA product Design c-3 comprising derived and/or modified sequence from HRSV(Memphis-37)__AIY60635.1__N (opt11)
  source 1..1551: mol_type = other RNA
gggagagtccgctcagccaggttgcagaagcggcttagcgtgtgtcctaatcttctctctgcgtgtaggtaggcctgtgccgcaaacaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20326 - RNA, 1547 nt, synthetic construct
  misc_feature 1..1547: note = mRNA product Design c-4 comprising derived and/or modified sequence from HRSV(Memphis-37)__AIY60635.1__N (wt)
  source 1..1547: mol_type = other RNA
gggagagtccgctcagccaggttgcagaagcggcttagcgtgtgtcctaatcttctctctgcgtgtaggtaggcctgtgccgcaaacaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20327 - RNA, 1547 nt, synthetic construct
  misc_feature 1..1547: note = mRNA product Design c-4 comprising derived and/or modified sequence from HRSV(Memphis-37)__AIY60635.1__N (opt1)
  source 1..1547: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20328 - RNA, 1547 nt, synthetic construct
  misc_feature 1..1547: note = mRNA product Design c-4 comprising derived and/or modified sequence from HRSV(Memphis-37)__AIY60635.1__N (opt2)
  source 1..1547: mol_type = other RNA
gggagagtccgctcagccaggttgcagaagcggcttagcgtgtgtcctaatcttctctctgcgtgtaggtaggcctgtgccgcaaacaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20329 - RNA, 1547 nt, synthetic construct
  misc_feature 1..1547: note = mRNA product Design c-4 comprising derived and/or modified sequence from HRSV(Memphis-37)__AIY60635.1__N (opt3)
  source 1..1547: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20330 - RNA, 1547 nt, synthetic construct
  misc_feature 1..1547: note = mRNA product Design c-4 comprising derived and/or modified sequence from HRSV(Memphis-37)__AIY60635.1__N (opt4)
  source 1..1547: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20331 - RNA, 1547 nt, synthetic construct
  misc_feature 1..1547: note = mRNA product Design c-4 comprising derived and/or modified sequence from HRSV(Memphis-37)__AIY60635.1__N (opt5)
  source 1..1547: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20332 - RNA, 1547 nt, synthetic construct
  misc_feature 1..1547: note = mRNA product Design c-4 comprising derived and/or modified sequence from HRSV(Memphis-37)__AIY60635.1__N (opt6)
  source 1..1547: mol_type = other RNA
gggagagtccgctcagccaggttgcagaagcggcttagcgtgtgtcctaatcttctctctgcgtgtaggtaggcctgtgccgcaaacaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20333 - RNA, 1547 nt, synthetic construct
  misc_feature 1..1547: note = mRNA product Design c-4 comprising derived and/or modified sequence from HRSV(Memphis-37)__AIY60635.1__N (opt11)
  source 1..1547: mol_type = other RNA
gggagagtccgctcagccaggttgcagaagcggcttagcgtgtgtcctaatcttctctctgcgtgtaggtaggcctgtgccgcaaacaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20334 - RNA, 1465 nt, synthetic construct
  misc_feature 1..1465: note = mRNA product Design c-5 comprising derived and/or modified sequence from HRSV(Memphis-37)__AIY60635.1__N (wt)
  source 1..1465: mol_type = other RNA
gggagagcggctcggccattttgtcccagtcagtccggaggctgcggctgcagaagtaccgcctgcggagtaactgcaaagaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20335 - RNA, 1465 nt, synthetic construct
  misc_feature 1..1465: note = mRNA product Design c-5 comprising derived and/or modified sequence from HRSV(Memphis-37)__AIY60635.1__N (opt1)
  source 1..1465: mol_type = other RNA
gggagagcggctcggccattttgtcccagtcagtccggaggctgcggctgcagaagtaccgcctgcggagtaactgcaaagaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20336 - RNA, 1465 nt, synthetic construct
  misc_feature 1..1465: note = mRNA product Design c-5 comprising derived and/or modified sequence from HRSV(Memphis-37)__AIY60635.1__N (opt2)
  source 1..1465: mol_type = other RNA
gggagagcggctcggccattttgtcccagtcagtccggaggctgcggctgcagaagtaccgcctgcggagtaactgcaaagaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20337 - RNA, 1465 nt, synthetic construct
  misc_feature 1..1465: note = mRNA product Design c-5 comprising derived and/or modified sequence from HRSV(Memphis-37)__AIY60635.1__N (opt3)
  source 1..1465: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20338 - RNA, 1465 nt, synthetic construct
  misc_feature 1..1465: note = mRNA product Design c-5 comprising derived and/or modified sequence from HRSV(Memphis-37)__AIY60635.1__N (opt4)
  source 1..1465: mol_type = other RNA
gggagagcggctcggccattttgtcccagtcagtccggaggctgcggctgcagaagtaccgcctgcggagtaactgcaaagaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20339 - RNA, 1465 nt, synthetic construct
  misc_feature 1..1465: note = mRNA product Design c-5 comprising derived and/or modified sequence from HRSV(Memphis-37)__AIY60635.1__N (opt5)
  source 1..1465: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20340 - RNA, 1465 nt, synthetic construct
  misc_feature 1..1465: note = mRNA product Design c-5 comprising derived and/or modified sequence from HRSV(Memphis-37)__AIY60635.1__N (opt6)
  source 1..1465: mol_type = other RNA
gggagagcggctcggccattttgtcccagtcagtccggaggctgcggctgcagaagtaccgcctgcggagtaactgcaaagaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20341 - RNA, 1465 nt, synthetic construct
  misc_feature 1..1465: note = mRNA product Design c-5 comprising derived and/or modified sequence from HRSV(Memphis-37)__AIY60635.1__N (opt11)
  source 1..1465: mol_type = other RNA
gggagagcggctcggccattttgtcccagtcagtccggaggctgcggctgcagaagtaccgcctgcggagtaactgcaaagaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20342 - RNA, 1474 nt, synthetic construct
  misc_feature 1..1474: note = mRNA product Design d-1 comprising derived and/or modified sequence from HRSV(Memphis-37)__AIY60635.1__N (wt)
  source 1..1474: mol_type = other RNA
gggagacccgtgacccggaagttgtacggctacgcgactttccctcccacaaaccctcgcgcccttcctttcctacttgggcccggcagaaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20343 - RNA, 1474 nt, synthetic construct
  misc_feature 1..1474: note = mRNA product Design d-1 comprising derived and/or modified sequence from HRSV(Memphis-37)__AIY60635.1__N (opt1)
  source 1..1474: mol_type = other RNA
gggagacccgtgacccggaagttgtacggctacgcgactttccctcccacaaaccctcgcgcccttcctttcctacttgggcccggcagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20344 - RNA, 1474 nt, synthetic construct
  misc_feature 1..1474: note = mRNA product Design d-1 comprising derived and/or modified sequence from HRSV(Memphis-37)__AIY60635.1__N (opt2)
  source 1..1474: mol_type = other RNA
gggagacccgtgacccggaagttgtacggctacgcgactttccctcccacaaaccctcgcgcccttcctttcctacttgggcccggcagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20345 - RNA, 1474 nt, synthetic construct
  misc_feature 1..1474: note = mRNA product Design d-1 comprising derived and/or modified sequence from HRSV(Memphis-37)__AIY60635.1__N (opt3)
  source 1..1474: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20346 - RNA, 1474 nt, synthetic construct
  misc_feature 1..1474: note = mRNA product Design d-1 comprising derived and/or modified sequence from HRSV(Memphis-37)__AIY60635.1__N (opt4)
  source 1..1474: mol_type = other RNA
gggagacccgtgacccggaagttgtacggctacgcgactttccctcccacaaaccctcgcgcccttcctttcctacttgggcccggcagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20347 - RNA, 1474 nt, synthetic construct
  misc_feature 1..1474: note = mRNA product Design d-1 comprising derived and/or modified sequence from HRSV(Memphis-37)__AIY60635.1__N (opt5)
  source 1..1474: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20348 - RNA, 1474 nt, synthetic construct
  misc_feature 1..1474: note = mRNA product Design d-1 comprising derived and/or modified sequence from HRSV(Memphis-37)__AIY60635.1__N (opt6)
  source 1..1474: mol_type = other RNA
gggagacccgtgacccggaagttgtacggctacgcgactttccctcccacaaaccctcgcgcccttcctttcctacttgggcccggcagaaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20349 - RNA, 1474 nt, synthetic construct
  misc_feature 1..1474: note = mRNA product Design d-1 comprising derived and/or modified sequence from HRSV(Memphis-37)__AIY60635.1__N (opt11)
  source 1..1474: mol_type = other RNA
gggagacccgtgacccggaagttgtacggctacgcgactttccctcccacaaaccctcgcgcccttcctttcctacttgggcccggcagaaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20350 - RNA, 1529 nt, synthetic construct
  misc_feature 1..1529: note = mRNA product Design d-2 comprising derived and/or modified sequence from HRSV(Memphis-37)__AIY60635.1__N (wt)
  source 1..1529: mol_type = other RNA
gggagagcggctcggccattttgtcccagtcagtccggaggctgcggctgcagaagtaccgcctgcggagtaactgcaaagaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20351 - RNA, 1529 nt, synthetic construct
  misc_feature 1..1529: note = mRNA product Design d-2 comprising derived and/or modified sequence from HRSV(Memphis-37)__AIY60635.1__N (opt1)
  source 1..1529: mol_type = other RNA
gggagagcggctcggccattttgtcccagtcagtccggaggctgcggctgcagaagtaccgcctgcggagtaactgcaaagaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20352 - RNA, 1529 nt, synthetic construct
  misc_feature 1..1529: note = mRNA product Design d-2 comprising derived and/or modified sequence from HRSV(Memphis-37)__AIY60635.1__N (opt2)
  source 1..1529: mol_type = other RNA
gggagagcggctcggccattttgtcccagtcagtccggaggctgcggctgcagaagtaccgcctgcggagtaactgcaaagaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20353 - RNA, 1529 nt, synthetic construct
  misc_feature 1..1529: note = mRNA product Design d-2 comprising derived and/or modified sequence from HRSV(Memphis-37)__AIY60635.1__N (opt3)
  source 1..1529: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20354 - RNA, 1529 nt, synthetic construct
  misc_feature 1..1529: note = mRNA product Design d-2 comprising derived and/or modified sequence from HRSV(Memphis-37)__AIY60635.1__N (opt4)
  source 1..1529: mol_type = other RNA
gggagagcggctcggccattttgtcccagtcagtccggaggctgcggctgcagaagtaccgcctgcggagtaactgcaaagaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20355 - RNA, 1529 nt, synthetic construct
  misc_feature 1..1529: note = mRNA product Design d-2 comprising derived and/or modified sequence from HRSV(Memphis-37)__AIY60635.1__N (opt5)
  source 1..1529: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20356 - RNA, 1529 nt, synthetic construct
  misc_feature 1..1529: note = mRNA product Design d-2 comprising derived and/or modified sequence from HRSV(Memphis-37)__AIY60635.1__N (opt6)
  source 1..1529: mol_type = other RNA
gggagagcggctcggccattttgtcccagtcagtccggaggctgcggctgcagaagtaccgcctgcggagtaactgcaaagaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20357 - RNA, 1529 nt, synthetic construct
  misc_feature 1..1529: note = mRNA product Design d-2 comprising derived and/or modified sequence from HRSV(Memphis-37)__AIY60635.1__N (opt11)
  source 1..1529: mol_type = other RNA
gggagagcggctcggccattttgtcccagtcagtccggaggctgcggctgcagaagtaccgcctgcggagtaactgcaaagaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20358 - RNA, 1845 nt, synthetic construct
  misc_feature 1..1845: note = mRNA product Design d-3 comprising derived and/or modified sequence from HRSV(Memphis-37)__AIY60635.1__N (wt)
  source 1..1845: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20359 - RNA, 1845 nt, synthetic construct
  misc_feature 1..1845: note = mRNA product Design d-3 comprising derived and/or modified sequence from HRSV(Memphis-37)__AIY60635.1__N (opt1)
  source 1..1845: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20360 - RNA, 1845 nt, synthetic construct
  misc_feature 1..1845: note = mRNA product Design d-3 comprising derived and/or modified sequence from HRSV(Memphis-37)__AIY60635.1__N (opt2)
  source 1..1845: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20361 - RNA, 1845 nt, synthetic construct
  misc_feature 1..1845: note = mRNA product Design d-3 comprising derived and/or modified sequence from HRSV(Memphis-37)__AIY60635.1__N (opt3)
  source 1..1845: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20362 - RNA, 1845 nt, synthetic construct
  misc_feature 1..1845: note = mRNA product Design d-3 comprising derived and/or modified sequence from HRSV(Memphis-37)__AIY60635.1__N (opt4)
  source 1..1845: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20363 - RNA, 1845 nt, synthetic construct
  misc_feature 1..1845: note = mRNA product Design d-3 comprising derived and/or modified sequence from HRSV(Memphis-37)__AIY60635.1__N (opt5)
  source 1..1845: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20364 - RNA, 1845 nt, synthetic construct
  misc_feature 1..1845: note = mRNA product Design d-3 comprising derived and/or modified sequence from HRSV(Memphis-37)__AIY60635.1__N (opt6)
  source 1..1845: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20365 - RNA, 1845 nt, synthetic construct
  misc_feature 1..1845: note = mRNA product Design d-3 comprising derived and/or modified sequence from HRSV(Memphis-37)__AIY60635.1__N (opt11)
  source 1..1845: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20366 - RNA, 1528 nt, synthetic construct
  misc_feature 1..1528: note = mRNA product Design d-4 comprising derived and/or modified sequence from HRSV(Memphis-37)__AIY60635.1__N (wt)
  source 1..1528: mol_type = other RNA
gggagagtcccgcagtcggcgtccagcggctctgcttgttcgtgtgtgtgtcgttgcaggccttattcaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20367 - RNA, 1528 nt, synthetic construct
  misc_feature 1..1528: note = mRNA product Design d-4 comprising derived and/or modified sequence from HRSV(Memphis-37)__AIY60635.1__N (opt1)
  source 1..1528: mol_type = other RNA
gggagagtcccgcagtcggcgtccagcggctctgcttgttcgtgtgtgtgtcgttgcaggccttattcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20368 - RNA, 1528 nt, synthetic construct
  misc_feature 1..1528: note = mRNA product Design d-4 comprising derived and/or modified sequence from HRSV(Memphis-37)__AIY60635.1__N (opt2)
  source 1..1528: mol_type = other RNA
gggagagtcccgcagtcggcgtccagcggctctgcttgttcgtgtgtgtgtcgttgcaggccttattcaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20369 - RNA, 1528 nt, synthetic construct
  misc_feature 1..1528: note = mRNA product Design d-4 comprising derived and/or modified sequence from HRSV(Memphis-37)__AIY60635.1__N (opt3)
  source 1..1528: mol_type = other RNA
gggagagtcccgcagtcggcgtccagcggctctgcttgttcgtgtgtgtgtcgttgcaggccttattcaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20370 - RNA, 1528 nt, synthetic construct
  misc_feature 1..1528: note = mRNA product Design d-4 comprising derived and/or modified sequence from HRSV(Memphis-37)__AIY60635.1__N (opt4)
  source 1..1528: mol_type = other RNA
gggagagtcccgcagtcggcgtccagcggctctgcttgttcgtgtgtgtgtcgttgcaggccttattcaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20371 - RNA, 1528 nt, synthetic construct
  misc_feature 1..1528: note = mRNA product Design d-4 comprising derived and/or modified sequence from HRSV(Memphis-37)__AIY60635.1__N (opt5)
  source 1..1528: mol_type = other RNA
gggagagtcccgcagtcggcgtccagcggctctgcttgttcgtgtgtgtgtcgttgcaggccttattcaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20372 - RNA, 1528 nt, synthetic construct
  misc_feature 1..1528: note = mRNA product Design d-4 comprising derived and/or modified sequence from HRSV(Memphis-37)__AIY60635.1__N (opt6)
  source 1..1528: mol_type = other RNA
gggagagtcccgcagtcggcgtccagcggctctgcttgttcgtgtgtgtgtcgttgcaggccttattcaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20373 - RNA, 1528 nt, synthetic construct
  misc_feature 1..1528: note = mRNA product Design d-4 comprising derived and/or modified sequence from HRSV(Memphis-37)__AIY60635.1__N (opt11)
  source 1..1528: mol_type = other RNA
gggagagtcccgcagtcggcgtccagcggctctgcttgttcgtgtgtgtgtcgttgcaggccttattcaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20374 - RNA, 1625 nt, synthetic construct
  misc_feature 1..1625: note = mRNA product Design d-5 comprising derived and/or modified sequence from HRSV(Memphis-37)__AIY60635.1__N (wt)
  source 1..1625: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20375 - RNA, 1625 nt, synthetic construct
  misc_feature 1..1625: note = mRNA product Design d-5 comprising derived and/or modified sequence from HRSV(Memphis-37)__AIY60635.1__N (opt1)
  source 1..1625: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20376 - RNA, 1625 nt, synthetic construct
  misc_feature 1..1625: note = mRNA product Design d-5 comprising derived and/or modified sequence from HRSV(Memphis-37)__AIY60635.1__N (opt2)
  source 1..1625: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20377 - RNA, 1625 nt, synthetic construct
  misc_feature 1..1625: note = mRNA product Design d-5 comprising derived and/or modified sequence from HRSV(Memphis-37)__AIY60635.1__N (opt3)
  source 1..1625: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20378 - RNA, 1625 nt, synthetic construct
  misc_feature 1..1625: note = mRNA product Design d-5 comprising derived and/or modified sequence from HRSV(Memphis-37)__AIY60635.1__N (opt4)
  source 1..1625: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20379 - RNA, 1625 nt, synthetic construct
  misc_feature 1..1625: note = mRNA product Design d-5 comprising derived and/or modified sequence from HRSV(Memphis-37)__AIY60635.1__N (opt5)
  source 1..1625: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20380 - RNA, 1625 nt, synthetic construct
  misc_feature 1..1625: note = mRNA product Design d-5 comprising derived and/or modified sequence from HRSV(Memphis-37)__AIY60635.1__N (opt6)
  source 1..1625: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20381 - RNA, 1625 nt, synthetic construct
  misc_feature 1..1625: note = mRNA product Design d-5 comprising derived and/or modified sequence from HRSV(Memphis-37)__AIY60635.1__N (opt11)
  source 1..1625: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20382 - RNA, 1505 nt, synthetic construct
  misc_feature 1..1505: note = mRNA product Design e-1 comprising derived and/or modified sequence from HRSV(Memphis-37)__AIY60635.1__N (wt)
  source 1..1505: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20383 - RNA, 1505 nt, synthetic construct
  misc_feature 1..1505: note = mRNA product Design e-1 comprising derived and/or modified sequence from HRSV(Memphis-37)__AIY60635.1__N (opt1)
  source 1..1505: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20384 - RNA, 1505 nt, synthetic construct
  misc_feature 1..1505: note = mRNA product Design e-1 comprising derived and/or modified sequence from HRSV(Memphis-37)__AIY60635.1__N (opt2)
  source 1..1505: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20385 - RNA, 1505 nt, synthetic construct
  misc_feature 1..1505: note = mRNA product Design e-1 comprising derived and/or modified sequence from HRSV(Memphis-37)__AIY60635.1__N (opt3)
  source 1..1505: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20386 - RNA, 1505 nt, synthetic construct
  misc_feature 1..1505: note = mRNA product Design e-1 comprising derived and/or modified sequence from HRSV(Memphis-37)__AIY60635.1__N (opt4)
  source 1..1505: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20387 - RNA, 1505 nt, synthetic construct
  misc_feature 1..1505: note = mRNA product Design e-1 comprising derived and/or modified sequence from HRSV(Memphis-37)__AIY60635.1__N (opt5)
  source 1..1505: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20388 - RNA, 1505 nt, synthetic construct
  misc_feature 1..1505: note = mRNA product Design e-1 comprising derived and/or modified sequence from HRSV(Memphis-37)__AIY60635.1__N (opt6)
  source 1..1505: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20389 - RNA, 1505 nt, synthetic construct
  misc_feature 1..1505: note = mRNA product Design e-1 comprising derived and/or modified sequence from HRSV(Memphis-37)__AIY60635.1__N (opt11)
  source 1..1505: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20390 - RNA, 1487 nt, synthetic construct
  misc_feature 1..1487: note = mRNA product Design e-2 comprising derived and/or modified sequence from HRSV(Memphis-37)__AIY60635.1__N (wt)
  source 1..1487: mol_type = other RNA
gggagacccgtgacccggaagttgtacggctacgcgactttccctcccacaaaccctcgcgcccttcctttcctacttgggcccggcagaaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20391 - RNA, 1487 nt, synthetic construct
  misc_feature 1..1487: note = mRNA product Design e-2 comprising derived and/or modified sequence from HRSV(Memphis-37)__AIY60635.1__N (opt1)
  source 1..1487: mol_type = other RNA
gggagacccgtgacccggaagttgtacggctacgcgactttccctcccacaaaccctcgcgcccttcctttcctacttgggcccggcagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20392 - RNA, 1487 nt, synthetic construct
  misc_feature 1..1487: note = mRNA product Design e-2 comprising derived and/or modified sequence from HRSV(Memphis-37)__AIY60635.1__N (opt2)
  source 1..1487: mol_type = other RNA
gggagacccgtgacccggaagttgtacggctacgcgactttccctcccacaaaccctcgcgcccttcctttcctacttgggcccggcagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20393 - RNA, 1487 nt, synthetic construct
  misc_feature 1..1487: note = mRNA product Design e-2 comprising derived and/or modified sequence from HRSV(Memphis-37)__AIY60635.1__N (opt3)
  source 1..1487: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20394 - RNA, 1487 nt, synthetic construct
  misc_feature 1..1487: note = mRNA product Design e-2 comprising derived and/or modified sequence from HRSV(Memphis-37)__AIY60635.1__N (opt4)
  source 1..1487: mol_type = other RNA
gggagacccgtgacccggaagttgtacggctacgcgactttccctcccacaaaccctcgcgcccttcctttcctacttgggcccggcagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20395 - RNA, 1487 nt, synthetic construct
  misc_feature 1..1487: note = mRNA product Design e-2 comprising derived and/or modified sequence from HRSV(Memphis-37)__AIY60635.1__N (opt5)
  source 1..1487: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20396 - RNA, 1487 nt, synthetic construct
  misc_feature 1..1487: note = mRNA product Design e-2 comprising derived and/or modified sequence from HRSV(Memphis-37)__AIY60635.1__N (opt6)
  source 1..1487: mol_type = other RNA
gggagacccgtgacccggaagttgtacggctacgcgactttccctcccacaaaccctcgcgcccttcctttcctacttgggcccggcagaaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20397 - RNA, 1487 nt, synthetic construct
  misc_feature 1..1487: note = mRNA product Design e-2 comprising derived and/or modified sequence from HRSV(Memphis-37)__AIY60635.1__N (opt11)
  source 1..1487: mol_type = other RNA
gggagacccgtgacccggaagttgtacggctacgcgactttccctcccacaaaccctcgcgcccttcctttcctacttgggcccggcagaaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20398 - RNA, 1457 nt, synthetic construct
  misc_feature 1..1457: note = mRNA product Design e-3 comprising derived and/or modified sequence from HRSV(Memphis-37)__AIY60635.1__N (wt)
  source 1..1457: mol_type = other RNA
gggagactttcccattctgtagcagaatttggtgttgcctgtggtcttggtcccgcggagaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20399 - RNA, 1457 nt, synthetic construct
  misc_feature 1..1457: note = mRNA product Design e-3 comprising derived and/or modified sequence from HRSV(Memphis-37)__AIY60635.1__N (opt1)
  source 1..1457: mol_type = other RNA
gggagactttcccattctgtagcagaatttggtgttgcctgtggtcttggtcccgcggagaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20400 - RNA, 1457 nt, synthetic construct
  misc_feature 1..1457: note = mRNA product Design e-3 comprising derived and/or modified sequence from HRSV(Memphis-37)__AIY60635.1__N (opt2)
  source 1..1457: mol_type = other RNA
gggagactttcccattctgtagcagaatttggtgttgcctgtggtcttggtcccgcggagaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20401 - RNA, 1457 nt, synthetic construct
  misc_feature 1..1457: note = mRNA product Design e-3 comprising derived and/or modified sequence from HRSV(Memphis-37)__AIY60635.1__N (opt3)
  source 1..1457: mol_type = other RNA
gggagactttcccattctgtagcagaatttggtgttgcctgtggtcttggtcccgcggagaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20402 - RNA, 1457 nt, synthetic construct
  misc_feature 1..1457: note = mRNA product Design e-3 comprising derived and/or modified sequence from HRSV(Memphis-37)__AIY60635.1__N (opt4)
  source 1..1457: mol_type = other RNA
gggagactttcccattctgtagcagaatttggtgttgcctgtggtcttggtcccgcggagaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20403 - RNA, 1457 nt, synthetic construct
  misc_feature 1..1457: note = mRNA product Design e-3 comprising derived and/or modified sequence from HRSV(Memphis-37)__AIY60635.1__N (opt5)
  source 1..1457: mol_type = other RNA
gggagactttcccattctgtagcagaatttggtgttgcctgtggtcttggtcccgcggagaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20404 - RNA, 1457 nt, synthetic construct
  misc_feature 1..1457: note = mRNA product Design e-3 comprising derived and/or modified sequence from HRSV(Memphis-37)__AIY60635.1__N (opt6)
  source 1..1457: mol_type = other RNA
gggagactttcccattctgtagcagaatttggtgttgcctgtggtcttggtcccgcggagaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20405 - RNA, 1457 nt, synthetic construct
  misc_feature 1..1457: note = mRNA product Design e-3 comprising derived and/or modified sequence from HRSV(Memphis-37)__AIY60635.1__N (opt11)
  source 1..1457: mol_type = other RNA
gggagactttcccattctgtagcagaatttggtgttgcctgtggtcttggtcccgcggagaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20406 - RNA, 1511 nt, synthetic construct
  misc_feature 1..1511: note = mRNA product Design e-4 comprising derived and/or modified sequence from HRSV(Memphis-37)__AIY60635.1__N (wt)
  source 1..1511: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20407 - RNA, 1511 nt, synthetic construct
  misc_feature 1..1511: note = mRNA product Design e-4 comprising derived and/or modified sequence from HRSV(Memphis-37)__AIY60635.1__N (opt1)
  source 1..1511: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20408 - RNA, 1511 nt, synthetic construct
  misc_feature 1..1511: note = mRNA product Design e-4 comprising derived and/or modified sequence from HRSV(Memphis-37)__AIY60635.1__N (opt2)
  source 1..1511: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20409 - RNA, 1511 nt, synthetic construct
  misc_feature 1..1511: note = mRNA product Design e-4 comprising derived and/or modified sequence from HRSV(Memphis-37)__AIY60635.1__N (opt3)
  source 1..1511: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20410 - RNA, 1511 nt, synthetic construct
  misc_feature 1..1511: note = mRNA product Design e-4 comprising derived and/or modified sequence from HRSV(Memphis-37)__AIY60635.1__N (opt4)
  source 1..1511: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20411 - RNA, 1511 nt, synthetic construct
  misc_feature 1..1511: note = mRNA product Design e-4 comprising derived and/or modified sequence from HRSV(Memphis-37)__AIY60635.1__N (opt5)
  source 1..1511: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20412 - RNA, 1511 nt, synthetic construct
  misc_feature 1..1511: note = mRNA product Design e-4 comprising derived and/or modified sequence from HRSV(Memphis-37)__AIY60635.1__N (opt6)
  source 1..1511: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20413 - RNA, 1511 nt, synthetic construct
  misc_feature 1..1511: note = mRNA product Design e-4 comprising derived and/or modified sequence from HRSV(Memphis-37)__AIY60635.1__N (opt11)
  source 1..1511: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20414 - RNA, 1478 nt, synthetic construct
  misc_feature 1..1478: note = mRNA product Design e-5 comprising derived and/or modified sequence from HRSV(Memphis-37)__AIY60635.1__N (wt)
  source 1..1478: mol_type = other RNA
gggagagcggctcggccattttgtcccagtcagtccggaggctgcggctgcagaagtaccgcctgcggagtaactgcaaagaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20415 - RNA, 1478 nt, synthetic construct
  misc_feature 1..1478: note = mRNA product Design e-5 comprising derived and/or modified sequence from HRSV(Memphis-37)__AIY60635.1__N (opt1)
  source 1..1478: mol_type = other RNA
gggagagcggctcggccattttgtcccagtcagtccggaggctgcggctgcagaagtaccgcctgcggagtaactgcaaagaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20416 - RNA, 1478 nt, synthetic construct
  misc_feature 1..1478: note = mRNA product Design e-5 comprising derived and/or modified sequence from HRSV(Memphis-37)__AIY60635.1__N (opt2)
  source 1..1478: mol_type = other RNA
gggagagcggctcggccattttgtcccagtcagtccggaggctgcggctgcagaagtaccgcctgcggagtaactgcaaagaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20417 - RNA, 1478 nt, synthetic construct
  misc_feature 1..1478: note = mRNA product Design e-5 comprising derived and/or modified sequence from HRSV(Memphis-37)__AIY60635.1__N (opt3)
  source 1..1478: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20418 - RNA, 1478 nt, synthetic construct
  misc_feature 1..1478: note = mRNA product Design e-5 comprising derived and/or modified sequence from HRSV(Memphis-37)__AIY60635.1__N (opt4)
  source 1..1478: mol_type = other RNA
gggagagcggctcggccattttgtcccagtcagtccggaggctgcggctgcagaagtaccgcctgcggagtaactgcaaagaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20419 - RNA, 1478 nt, synthetic construct
  misc_feature 1..1478: note = mRNA product Design e-5 comprising derived and/or modified sequence from HRSV(Memphis-37)__AIY60635.1__N (opt5)
  source 1..1478: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20420 - RNA, 1478 nt, synthetic construct
  misc_feature 1..1478: note = mRNA product Design e-5 comprising derived and/or modified sequence from HRSV(Memphis-37)__AIY60635.1__N (opt6)
  source 1..1478: mol_type = other RNA
gggagagcggctcggccattttgtcccagtcagtccggaggctgcggctgcagaagtaccgcctgcggagtaactgcaaagaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20421 - RNA, 1478 nt, synthetic construct
  misc_feature 1..1478: note = mRNA product Design e-5 comprising derived and/or modified sequence from HRSV(Memphis-37)__AIY60635.1__N (opt11)
  source 1..1478: mol_type = other RNA
gggagagcggctcggccattttgtcccagtcagtccggaggctgcggctgcagaagtaccgcctgcggagtaactgcaaagaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20422 - RNA, 1545 nt, synthetic construct
  misc_feature 1..1545: note = mRNA product Design e-6 comprising derived and/or modified sequence from HRSV(Memphis-37)__AIY60635.1__N (wt)
  source 1..1545: mol_type = other RNA
gggagagcggctcggccattttgtcccagtcagtccggaggctgcggctgcagaagtaccgcctgcggagtaactgcaaagaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20423 - RNA, 1545 nt, synthetic construct
  misc_feature 1..1545: note = mRNA product Design e-6 comprising derived and/or modified sequence from HRSV(Memphis-37)__AIY60635.1__N (opt1)
  source 1..1545: mol_type = other RNA
gggagagcggctcggccattttgtcccagtcagtccggaggctgcggctgcagaagtaccgcctgcggagtaactgcaaagaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20424 - RNA, 1545 nt, synthetic construct
  misc_feature 1..1545: note = mRNA product Design e-6 comprising derived and/or modified sequence from HRSV(Memphis-37)__AIY60635.1__N (opt2)
  source 1..1545: mol_type = other RNA
gggagagcggctcggccattttgtcccagtcagtccggaggctgcggctgcagaagtaccgcctgcggagtaactgcaaagaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20425 - RNA, 1545 nt, synthetic construct
  misc_feature 1..1545: note = mRNA product Design e-6 comprising derived and/or modified sequence from HRSV(Memphis-37)__AIY60635.1__N (opt3)
  source 1..1545: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20426 - RNA, 1545 nt, synthetic construct
  misc_feature 1..1545: note = mRNA product Design e-6 comprising derived and/or modified sequence from HRSV(Memphis-37)__AIY60635.1__N (opt4)
  source 1..1545: mol_type = other RNA
gggagagcggctcggccattttgtcccagtcagtccggaggctgcggctgcagaagtaccgcctgcggagtaactgcaaagaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20427 - RNA, 1545 nt, synthetic construct
  misc_feature 1..1545: note = mRNA product Design e-6 comprising derived and/or modified sequence from HRSV(Memphis-37)__AIY60635.1__N (opt5)
  source 1..1545: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20428 - RNA, 1545 nt, synthetic construct
  misc_feature 1..1545: note = mRNA product Design e-6 comprising derived and/or modified sequence from HRSV(Memphis-37)__AIY60635.1__N (opt6)
  source 1..1545: mol_type = other RNA
gggagagcggctcggccattttgtcccagtcagtccggaggctgcggctgcagaagtaccgcctgcggagtaactgcaaagaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20429 - RNA, 1545 nt, synthetic construct
  misc_feature 1..1545: note = mRNA product Design e-6 comprising derived and/or modified sequence from HRSV(Memphis-37)__AIY60635.1__N (opt11)
  source 1..1545: mol_type = other RNA
gggagagcggctcggccattttgtcccagtcagtccggaggctgcggctgcagaagtaccgcctgcggagtaactgcaaagaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20430 - RNA, 1761 nt, synthetic construct
  misc_feature 1..1761: note = mRNA product Design f-1 comprising derived and/or modified sequence from HRSV(Memphis-37)__AIY60635.1__N (wt)
  source 1..1761: mol_type = other RNA
gggagagcggctcggccattttgtcccagtcagtccggaggctgcggctgcagaagtaccgcctgcggagtaactgcaaagaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20431 - RNA, 1761 nt, synthetic construct
  misc_feature 1..1761: note = mRNA product Design f-1 comprising derived and/or modified sequence from HRSV(Memphis-37)__AIY60635.1__N (opt1)
  source 1..1761: mol_type = other RNA
gggagagcggctcggccattttgtcccagtcagtccggaggctgcggctgcagaagtaccgcctgcggagtaactgcaaagaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20432 - RNA, 1761 nt, synthetic construct
  misc_feature 1..1761: note = mRNA product Design f-1 comprising derived and/or modified sequence from HRSV(Memphis-37)__AIY60635.1__N (opt2)
  source 1..1761: mol_type = other RNA
gggagagcggctcggccattttgtcccagtcagtccggaggctgcggctgcagaagtaccgcctgcggagtaactgcaaagaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20433 - RNA, 1761 nt, synthetic construct
  misc_feature 1..1761: note = mRNA product Design f-1 comprising derived and/or modified sequence from HRSV(Memphis-37)__AIY60635.1__N (opt3)
  source 1..1761: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20434 - RNA, 1761 nt, synthetic construct
  misc_feature 1..1761: note = mRNA product Design f-1 comprising derived and/or modified sequence from HRSV(Memphis-37)__AIY60635.1__N (opt4)
  source 1..1761: mol_type = other RNA
gggagagcggctcggccattttgtcccagtcagtccggaggctgcggctgcagaagtaccgcctgcggagtaactgcaaagaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20435 - RNA, 1761 nt, synthetic construct
  misc_feature 1..1761: note = mRNA product Design f-1 comprising derived and/or modified sequence from HRSV(Memphis-37)__AIY60635.1__N (opt5)
  source 1..1761: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20436 - RNA, 1761 nt, synthetic construct
  misc_feature 1..1761: note = mRNA product Design f-1 comprising derived and/or modified sequence from HRSV(Memphis-37)__AIY60635.1__N (opt6)
  source 1..1761: mol_type = other RNA
gggagagcggctcggccattttgtcccagtcagtccggaggctgcggctgcagaagtaccgcctgcggagtaactgcaaagaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20437 - RNA, 1761 nt, synthetic construct
  misc_feature 1..1761: note = mRNA product Design f-1 comprising derived and/or modified sequence from HRSV(Memphis-37)__AIY60635.1__N (opt11)
  source 1..1761: mol_type = other RNA
gggagagcggctcggccattttgtcccagtcagtccggaggctgcggctgcagaagtaccgcctgcggagtaactgcaaagaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20438 - RNA, 1541 nt, synthetic construct
  misc_feature 1..1541: note = mRNA product Design f-2 comprising derived and/or modified sequence from HRSV(Memphis-37)__AIY60635.1__N (wt)
  source 1..1541: mol_type = other RNA
gggagagcggctcggccattttgtcccagtcagtccggaggctgcggctgcagaagtaccgcctgcggagtaactgcaaagaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20439 - RNA, 1541 nt, synthetic construct
  misc_feature 1..1541: note = mRNA product Design f-2 comprising derived and/or modified sequence from HRSV(Memphis-37)__AIY60635.1__N (opt1)
  source 1..1541: mol_type = other RNA
gggagagcggctcggccattttgtcccagtcagtccggaggctgcggctgcagaagtaccgcctgcggagtaactgcaaagaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20440 - RNA, 1541 nt, synthetic construct
  misc_feature 1..1541: note = mRNA product Design f-2 comprising derived and/or modified sequence from HRSV(Memphis-37)__AIY60635.1__N (opt2)
  source 1..1541: mol_type = other RNA
gggagagcggctcggccattttgtcccagtcagtccggaggctgcggctgcagaagtaccgcctgcggagtaactgcaaagaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20441 - RNA, 1541 nt, synthetic construct
  misc_feature 1..1541: note = mRNA product Design f-2 comprising derived and/or modified sequence from HRSV(Memphis-37)__AIY60635.1__N (opt3)
  source 1..1541: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20442 - RNA, 1541 nt, synthetic construct
  misc_feature 1..1541: note = mRNA product Design f-2 comprising derived and/or modified sequence from HRSV(Memphis-37)__AIY60635.1__N (opt4)
  source 1..1541: mol_type = other RNA
gggagagcggctcggccattttgtcccagtcagtccggaggctgcggctgcagaagtaccgcctgcggagtaactgcaaagaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20443 - RNA, 1541 nt, synthetic construct
  misc_feature 1..1541: note = mRNA product Design f-2 comprising derived and/or modified sequence from HRSV(Memphis-37)__AIY60635.1__N (opt5)
  source 1..1541: mol_type = other RNA
gggagagcggctcggccattttgtcccagtcagtccggaggctgcggctgcagaagtaccgcctgcggagtaactgcaaagaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20444 - RNA, 1541 nt, synthetic construct
  misc_feature 1..1541: note = mRNA product Design f-2 comprising derived and/or modified sequence from HRSV(Memphis-37)__AIY60635.1__N (opt6)
  source 1..1541: mol_type = other RNA
gggagagcggctcggccattttgtcccagtcagtccggaggctgcggctgcagaagtaccgcctgcggagtaactgcaaagaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20445 - RNA, 1541 nt, synthetic construct
  misc_feature 1..1541: note = mRNA product Design f-2 comprising derived and/or modified sequence from HRSV(Memphis-37)__AIY60635.1__N (opt11)
  source 1..1541: mol_type = other RNA
gggagagcggctcggccattttgtcccagtcagtccggaggctgcggctgcagaagtaccgcctgcggagtaactgcaaagaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20446 - RNA, 1532 nt, synthetic construct
  misc_feature 1..1532: note = mRNA product Design f-3 comprising derived and/or modified sequence from HRSV(Memphis-37)__AIY60635.1__N (wt)
  source 1..1532: mol_type = other RNA
gggagagtcccgcagtcggcgtccagcggctctgcttgttcgtgtgtgtgtcgttgcaggccttattcaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20447 - RNA, 1532 nt, synthetic construct
  misc_feature 1..1532: note = mRNA product Design f-3 comprising derived and/or modified sequence from HRSV(Memphis-37)__AIY60635.1__N (opt1)
  source 1..1532: mol_type = other RNA
gggagagtcccgcagtcggcgtccagcggctctgcttgttcgtgtgtgtgtcgttgcaggccttattcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20448 - RNA, 1532 nt, synthetic construct
  misc_feature 1..1532: note = mRNA product Design f-3 comprising derived and/or modified sequence from HRSV(Memphis-37)__AIY60635.1__N (opt2)
  source 1..1532: mol_type = other RNA
gggagagtcccgcagtcggcgtccagcggctctgcttgttcgtgtgtgtgtcgttgcaggccttattcaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20449 - RNA, 1532 nt, synthetic construct
  misc_feature 1..1532: note = mRNA product Design f-3 comprising derived and/or modified sequence from HRSV(Memphis-37)__AIY60635.1__N (opt3)
  source 1..1532: mol_type = other RNA
gggagagtcccgcagtcggcgtccagcggctctgcttgttcgtgtgtgtgtcgttgcaggccttattcaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20450 - RNA, 1532 nt, synthetic construct
  misc_feature 1..1532: note = mRNA product Design f-3 comprising derived and/or modified sequence from HRSV(Memphis-37)__AIY60635.1__N (opt4)
  source 1..1532: mol_type = other RNA
gggagagtcccgcagtcggcgtccagcggctctgcttgttcgtgtgtgtgtcgttgcaggccttattcaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20451 - RNA, 1532 nt, synthetic construct
  misc_feature 1..1532: note = mRNA product Design f-3 comprising derived and/or modified sequence from HRSV(Memphis-37)__AIY60635.1__N (opt5)
  source 1..1532: mol_type = other RNA
gggagagtcccgcagtcggcgtccagcggctctgcttgttcgtgtgtgtgtcgttgcaggccttattcaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20452 - RNA, 1532 nt, synthetic construct
  misc_feature 1..1532: note = mRNA product Design f-3 comprising derived and/or modified sequence from HRSV(Memphis-37)__AIY60635.1__N (opt6)
  source 1..1532: mol_type = other RNA
gggagagtcccgcagtcggcgtccagcggctctgcttgttcgtgtgtgtgtcgttgcaggccttattcaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20453 - RNA, 1532 nt, synthetic construct
  misc_feature 1..1532: note = mRNA product Design f-3 comprising derived and/or modified sequence from HRSV(Memphis-37)__AIY60635.1__N (opt11)
  source 1..1532: mol_type = other RNA
gggagagtcccgcagtcggcgtccagcggctctgcttgttcgtgtgtgtgtcgttgcaggccttattcaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20454 - RNA, 1748 nt, synthetic construct
  misc_feature 1..1748: note = mRNA product Design f-4 comprising derived and/or modified sequence from HRSV(Memphis-37)__AIY60635.1__N (wt)
  source 1..1748: mol_type = other RNA
gggagagtcccgcagtcggcgtccagcggctctgcttgttcgtgtgtgtgtcgttgcaggccttattcaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20455 - RNA, 1748 nt, synthetic construct
  misc_feature 1..1748: note = mRNA product Design f-4 comprising derived and/or modified sequence from HRSV(Memphis-37)__AIY60635.1__N (opt1)
  source 1..1748: mol_type = other RNA
gggagagtcccgcagtcggcgtccagcggctctgcttgttcgtgtgtgtgtcgttgcaggccttattcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20456 - RNA, 1748 nt, synthetic construct
  misc_feature 1..1748: note = mRNA product Design f-4 comprising derived and/or modified sequence from HRSV(Memphis-37)__AIY60635.1__N (opt2)
  source 1..1748: mol_type = other RNA
gggagagtcccgcagtcggcgtccagcggctctgcttgttcgtgtgtgtgtcgttgcaggccttattcaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20457 - RNA, 1748 nt, synthetic construct
  misc_feature 1..1748: note = mRNA product Design f-4 comprising derived and/or modified sequence from HRSV(Memphis-37)__AIY60635.1__N (opt3)
  source 1..1748: mol_type = other RNA
gggagagtcccgcagtcggcgtccagcggctctgcttgttcgtgtgtgtgtcgttgcaggccttattcaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20458 - RNA, 1748 nt, synthetic construct
  misc_feature 1..1748: note = mRNA product Design f-4 comprising derived and/or modified sequence from HRSV(Memphis-37)__AIY60635.1__N (opt4)
  source 1..1748: mol_type = other RNA
gggagagtcccgcagtcggcgtccagcggctctgcttgttcgtgtgtgtgtcgttgcaggccttattcaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20459 - RNA, 1748 nt, synthetic construct
  misc_feature 1..1748: note = mRNA product Design f-4 comprising derived and/or modified sequence from HRSV(Memphis-37)__AIY60635.1__N (opt5)
  source 1..1748: mol_type = other RNA
gggagagtcccgcagtcggcgtccagcggctctgcttgttcgtgtgtgtgtcgttgcaggccttattcaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20460 - RNA, 1748 nt, synthetic construct
  misc_feature 1..1748: note = mRNA product Design f-4 comprising derived and/or modified sequence from HRSV(Memphis-37)__AIY60635.1__N (opt6)
  source 1..1748: mol_type = other RNA
gggagagtcccgcagtcggcgtccagcggctctgcttgttcgtgtgtgtgtcgttgcaggccttattcaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20461 - RNA, 1748 nt, synthetic construct
  misc_feature 1..1748: note = mRNA product Design f-4 comprising derived and/or modified sequence from HRSV(Memphis-37)__AIY60635.1__N (opt11)
  source 1..1748: mol_type = other RNA
gggagagtcccgcagtcggcgtccagcggctctgcttgttcgtgtgtgtgtcgttgcaggccttattcaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20462 - RNA, 1524 nt, synthetic construct
  misc_feature 1..1524: note = mRNA product Design f-5 comprising derived and/or modified sequence from HRSV(Memphis-37)__AIY60635.1__N (wt)
  source 1..1524: mol_type = other RNA
gggagactttcccattctgtagcagaatttggtgttgcctgtggtcttggtcccgcggagaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20463 - RNA, 1524 nt, synthetic construct
  misc_feature 1..1524: note = mRNA product Design f-5 comprising derived and/or modified sequence from HRSV(Memphis-37)__AIY60635.1__N (opt1)
  source 1..1524: mol_type = other RNA
gggagactttcccattctgtagcagaatttggtgttgcctgtggtcttggtcccgcggagaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20464 - RNA, 1524 nt, synthetic construct
  misc_feature 1..1524: note = mRNA product Design f-5 comprising derived and/or modified sequence from HRSV(Memphis-37)__AIY60635.1__N (opt2)
  source 1..1524: mol_type = other RNA
gggagactttcccattctgtagcagaatttggtgttgcctgtggtcttggtcccgcggagaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20465 - RNA, 1524 nt, synthetic construct
  misc_feature 1..1524: note = mRNA product Design f-5 comprising derived and/or modified sequence from HRSV(Memphis-37)__AIY60635.1__N (opt3)
  source 1..1524: mol_type = other RNA
gggagactttcccattctgtagcagaatttggtgttgcctgtggtcttggtcccgcggagaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20466 - RNA, 1524 nt, synthetic construct
  misc_feature 1..1524: note = mRNA product Design f-5 comprising derived and/or modified sequence from HRSV(Memphis-37)__AIY60635.1__N (opt4)
  source 1..1524: mol_type = other RNA
gggagactttcccattctgtagcagaatttggtgttgcctgtggtcttggtcccgcggagaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20467 - RNA, 1524 nt, synthetic construct
  misc_feature 1..1524: note = mRNA product Design f-5 comprising derived and/or modified sequence from HRSV(Memphis-37)__AIY60635.1__N (opt5)
  source 1..1524: mol_type = other RNA
gggagactttcccattctgtagcagaatttggtgttgcctgtggtcttggtcccgcggagaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20468 - RNA, 1524 nt, synthetic construct
  misc_feature 1..1524: note = mRNA product Design f-5 comprising derived and/or modified sequence from HRSV(Memphis-37)__AIY60635.1__N (opt6)
  source 1..1524: mol_type = other RNA
gggagactttcccattctgtagcagaatttggtgttgcctgtggtcttggtcccgcggagaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20469 - RNA, 1524 nt, synthetic construct
  misc_feature 1..1524: note = mRNA product Design f-5 comprising derived and/or modified sequence from HRSV(Memphis-37)__AIY60635.1__N (opt11)
  source 1..1524: mol_type = other RNA
gggagactttcccattctgtagcagaatttggtgttgcctgtggtcttggtcccgcggagaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20470 - RNA, 1520 nt, synthetic construct
  misc_feature 1..1520: note = mRNA product Design g-1 comprising derived and/or modified sequence from HRSV(Memphis-37)__AIY60635.1__N (wt)
  source 1..1520: mol_type = other RNA
gggagactttcccattctgtagcagaatttggtgttgcctgtggtcttggtcccgcggagaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20471 - RNA, 1520 nt, synthetic construct
  misc_feature 1..1520: note = mRNA product Design g-1 comprising derived and/or modified sequence from HRSV(Memphis-37)__AIY60635.1__N (opt1)
  source 1..1520: mol_type = other RNA
gggagactttcccattctgtagcagaatttggtgttgcctgtggtcttggtcccgcggagaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20472 - RNA, 1520 nt, synthetic construct
  misc_feature 1..1520: note = mRNA product Design g-1 comprising derived and/or modified sequence from HRSV(Memphis-37)__AIY60635.1__N (opt2)
  source 1..1520: mol_type = other RNA
gggagactttcccattctgtagcagaatttggtgttgcctgtggtcttggtcccgcggagaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20473 - RNA, 1520 nt, synthetic construct
  misc_feature 1..1520: note = mRNA product Design g-1 comprising derived and/or modified sequence from HRSV(Memphis-37)__AIY60635.1__N (opt3)
  source 1..1520: mol_type = other RNA
gggagactttcccattctgtagcagaatttggtgttgcctgtggtcttggtcccgcggagaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20474 - RNA, 1520 nt, synthetic construct
  misc_feature 1..1520: note = mRNA product Design g-1 comprising derived and/or modified sequence from HRSV(Memphis-37)__AIY60635.1__N (opt4)
  source 1..1520: mol_type = other RNA
gggagactttcccattctgtagcagaatttggtgttgcctgtggtcttggtcccgcggagaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20475 - RNA, 1520 nt, synthetic construct
  misc_feature 1..1520: note = mRNA product Design g-1 comprising derived and/or modified sequence from HRSV(Memphis-37)__AIY60635.1__N (opt5)
  source 1..1520: mol_type = other RNA
gggagactttcccattctgtagcagaatttggtgttgcctgtggtcttggtcccgcggagaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20476 - RNA, 1520 nt, synthetic construct
  misc_feature 1..1520: note = mRNA product Design g-1 comprising derived and/or modified sequence from HRSV(Memphis-37)__AIY60635.1__N (opt6)
  source 1..1520: mol_type = other RNA
gggagactttcccattctgtagcagaatttggtgttgcctgtggtcttggtcccgcggagaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20477 - RNA, 1520 nt, synthetic construct
  misc_feature 1..1520: note = mRNA product Design g-1 comprising derived and/or modified sequence from HRSV(Memphis-37)__AIY60635.1__N (opt11)
  source 1..1520: mol_type = other RNA
gggagactttcccattctgtagcagaatttggtgttgcctgtggtcttggtcccgcggagaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20478 - RNA, 1535 nt, synthetic construct
  misc_feature 1..1535: note = mRNA product Design g-2 comprising derived and/or modified sequence from HRSV(Memphis-37)__AIY60635.1__N (wt)
  source 1..1535: mol_type = other RNA
gggagagtccgctcagccaggttgcagaagcggcttagcgtgtgtcctaatcttctctctgcgtgtaggtaggcctgtgccgcaaacaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20479 - RNA, 1535 nt, synthetic construct
  misc_feature 1..1535: note = mRNA product Design g-2 comprising derived and/or modified sequence from HRSV(Memphis-37)__AIY60635.1__N (opt1)
  source 1..1535: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20480 - RNA, 1535 nt, synthetic construct
  misc_feature 1..1535: note = mRNA product Design g-2 comprising derived and/or modified sequence from HRSV(Memphis-37)__AIY60635.1__N (opt2)
  source 1..1535: mol_type = other RNA
gggagagtccgctcagccaggttgcagaagcggcttagcgtgtgtcctaatcttctctctgcgtgtaggtaggcctgtgccgcaaacaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20481 - RNA, 1535 nt, synthetic construct
  misc_feature 1..1535: note = mRNA product Design g-2 comprising derived and/or modified sequence from HRSV(Memphis-37)__AIY60635.1__N (opt3)
  source 1..1535: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20482 - RNA, 1535 nt, synthetic construct
  misc_feature 1..1535: note = mRNA product Design g-2 comprising derived and/or modified sequence from HRSV(Memphis-37)__AIY60635.1__N (opt4)
  source 1..1535: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20483 - RNA, 1535 nt, synthetic construct
  misc_feature 1..1535: note = mRNA product Design g-2 comprising derived and/or modified sequence from HRSV(Memphis-37)__AIY60635.1__N (opt5)
  source 1..1535: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20484 - RNA, 1535 nt, synthetic construct
  misc_feature 1..1535: note = mRNA product Design g-2 comprising derived and/or modified sequence from HRSV(Memphis-37)__AIY60635.1__N (opt6)
  source 1..1535: mol_type = other RNA
gggagagtccgctcagccaggttgcagaagcggcttagcgtgtgtcctaatcttctctctgcgtgtaggtaggcctgtgccgcaaacaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20485 - RNA, 1535 nt, synthetic construct
  misc_feature 1..1535: note = mRNA product Design g-2 comprising derived and/or modified sequence from HRSV(Memphis-37)__AIY60635.1__N (opt11)
  source 1..1535: mol_type = other RNA
gggagagtccgctcagccaggttgcagaagcggcttagcgtgtgtcctaatcttctctctgcgtgtaggtaggcctgtgccgcaaacaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20486 - RNA, 1767 nt, synthetic construct
  misc_feature 1..1767: note = mRNA product Design g-3 comprising derived and/or modified sequence from HRSV(Memphis-37)__AIY60635.1__N (wt)
  source 1..1767: mol_type = other RNA
gggagagtccgctcagccaggttgcagaagcggcttagcgtgtgtcctaatcttctctctgcgtgtaggtaggcctgtgccgcaaacaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20487 - RNA, 1767 nt, synthetic construct
  misc_feature 1..1767: note = mRNA product Design g-3 comprising derived and/or modified sequence from HRSV(Memphis-37)__AIY60635.1__N (opt1)
  source 1..1767: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20488 - RNA, 1767 nt, synthetic construct
  misc_feature 1..1767: note = mRNA product Design g-3 comprising derived and/or modified sequence from HRSV(Memphis-37)__AIY60635.1__N (opt2)
  source 1..1767: mol_type = other RNA
gggagagtccgctcagccaggttgcagaagcggcttagcgtgtgtcctaatcttctctctgcgtgtaggtaggcctgtgccgcaaacaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20489 - RNA, 1767 nt, synthetic construct
  misc_feature 1..1767: note = mRNA product Design g-3 comprising derived and/or modified sequence from HRSV(Memphis-37)__AIY60635.1__N (opt3)
  source 1..1767: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20490 - RNA, 1767 nt, synthetic construct
  misc_feature 1..1767: note = mRNA product Design g-3 comprising derived and/or modified sequence from HRSV(Memphis-37)__AIY60635.1__N (opt4)
  source 1..1767: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20491 - RNA, 1767 nt, synthetic construct
  misc_feature 1..1767: note = mRNA product Design g-3 comprising derived and/or modified sequence from HRSV(Memphis-37)__AIY60635.1__N (opt5)
  source 1..1767: mol_type = other RNA
gggagagtccgctcagccaggttgcagaagcggcttagcgtgtgtcctaatcttctctctgcgtgtaggtaggcctgtgccgcaaacaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20492 - RNA, 1767 nt, synthetic construct
  misc_feature 1..1767: note = mRNA product Design g-3 comprising derived and/or modified sequence from HRSV(Memphis-37)__AIY60635.1__N (opt6)
  source 1..1767: mol_type = other RNA
gggagagtccgctcagccaggttgcagaagcggcttagcgtgtgtcctaatcttctctctgcgtgtaggtaggcctgtgccgcaaacaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20493 - RNA, 1767 nt, synthetic construct
  misc_feature 1..1767: note = mRNA product Design g-3 comprising derived and/or modified sequence from HRSV(Memphis-37)__AIY60635.1__N (opt11)
  source 1..1767: mol_type = other RNA
gggagagtccgctcagccaggttgcagaagcggcttagcgtgtgtcctaatcttctctctgcgtgtaggtaggcctgtgccgcaaacaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20494 - RNA, 1562 nt, synthetic construct
  misc_feature 1..1562: note = mRNA product Design g-4 comprising derived and/or modified sequence from HRSV(Memphis-37)__AIY60635.1__N (wt)
  source 1..1562: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20495 - RNA, 1562 nt, synthetic construct
  misc_feature 1..1562: note = mRNA product Design g-4 comprising derived and/or modified sequence from HRSV(Memphis-37)__AIY60635.1__N (opt1)
  source 1..1562: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20496 - RNA, 1562 nt, synthetic construct
  misc_feature 1..1562: note = mRNA product Design g-4 comprising derived and/or modified sequence from HRSV(Memphis-37)__AIY60635.1__N (opt2)
  source 1..1562: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20497 - RNA, 1562 nt, synthetic construct
  misc_feature 1..1562: note = mRNA product Design g-4 comprising derived and/or modified sequence from HRSV(Memphis-37)__AIY60635.1__N (opt3)
  source 1..1562: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20498 - RNA, 1562 nt, synthetic construct
  misc_feature 1..1562: note = mRNA product Design g-4 comprising derived and/or modified sequence from HRSV(Memphis-37)__AIY60635.1__N (opt4)
  source 1..1562: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20499 - RNA, 1562 nt, synthetic construct
  misc_feature 1..1562: note = mRNA product Design g-4 comprising derived and/or modified sequence from HRSV(Memphis-37)__AIY60635.1__N (opt5)
  source 1..1562: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20500 - RNA, 1562 nt, synthetic construct
  misc_feature 1..1562: note = mRNA product Design g-4 comprising derived and/or modified sequence from HRSV(Memphis-37)__AIY60635.1__N (opt6)
  source 1..1562: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20501 - RNA, 1562 nt, synthetic construct
  misc_feature 1..1562: note = mRNA product Design g-4 comprising derived and/or modified sequence from HRSV(Memphis-37)__AIY60635.1__N (opt11)
  source 1..1562: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20502 - RNA, 1538 nt, synthetic construct
  misc_feature 1..1538: note = mRNA product Design g-5 comprising derived and/or modified sequence from HRSV(Memphis-37)__AIY60635.1__N (wt)
  source 1..1538: mol_type = other RNA
gggagacccgtgacccggaagttgtacggctacgcgactttccctcccacaaaccctcgcgcccttcctttcctacttgggcccggcagaaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20503 - RNA, 1538 nt, synthetic construct
  misc_feature 1..1538: note = mRNA product Design g-5 comprising derived and/or modified sequence from HRSV(Memphis-37)__AIY60635.1__N (opt1)
  source 1..1538: mol_type = other RNA
gggagacccgtgacccggaagttgtacggctacgcgactttccctcccacaaaccctcgcgcccttcctttcctacttgggcccggcagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20504 - RNA, 1538 nt, synthetic construct
  misc_feature 1..1538: note = mRNA product Design g-5 comprising derived and/or modified sequence from HRSV(Memphis-37)__AIY60635.1__N (opt2)
  source 1..1538: mol_type = other RNA
gggagacccgtgacccggaagttgtacggctacgcgactttccctcccacaaaccctcgcgcccttcctttcctacttgggcccggcagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20505 - RNA, 1538 nt, synthetic construct
  misc_feature 1..1538: note = mRNA product Design g-5 comprising derived and/or modified sequence from HRSV(Memphis-37)__AIY60635.1__N (opt3)
  source 1..1538: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20506 - RNA, 1538 nt, synthetic construct
  misc_feature 1..1538: note = mRNA product Design g-5 comprising derived and/or modified sequence from HRSV(Memphis-37)__AIY60635.1__N (opt4)
  source 1..1538: mol_type = other RNA
gggagacccgtgacccggaagttgtacggctacgcgactttccctcccacaaaccctcgcgcccttcctttcctacttgggcccggcagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20507 - RNA, 1538 nt, synthetic construct
  misc_feature 1..1538: note = mRNA product Design g-5 comprising derived and/or modified sequence from HRSV(Memphis-37)__AIY60635.1__N (opt5)
  source 1..1538: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20508 - RNA, 1538 nt, synthetic construct
  misc_feature 1..1538: note = mRNA product Design g-5 comprising derived and/or modified sequence from HRSV(Memphis-37)__AIY60635.1__N (opt6)
  source 1..1538: mol_type = other RNA
gggagacccgtgacccggaagttgtacggctacgcgactttccctcccacaaaccctcgcgcccttcctttcctacttgggcccggcagaaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20509 - RNA, 1538 nt, synthetic construct
  misc_feature 1..1538: note = mRNA product Design g-5 comprising derived and/or modified sequence from HRSV(Memphis-37)__AIY60635.1__N (opt11)
  source 1..1538: mol_type = other RNA
gggagacccgtgacccggaagttgtacggctacgcgactttccctcccacaaaccctcgcgcccttcctttcctacttgggcccggcagaaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20510 - RNA, 1554 nt, synthetic construct
  misc_feature 1..1554: note = mRNA product Design h-1 comprising derived and/or modified sequence from HRSV(Memphis-37)__AIY60635.1__N (wt)
  source 1..1554: mol_type = other RNA
gggagacccgtgacccggaagttgtacggctacgcgactttccctcccacaaaccctcgcgcccttcctttcctacttgggcccggcagaaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20511 - RNA, 1554 nt, synthetic construct
  misc_feature 1..1554: note = mRNA product Design h-1 comprising derived and/or modified sequence from HRSV(Memphis-37)__AIY60635.1__N (opt1)
  source 1..1554: mol_type = other RNA
gggagacccgtgacccggaagttgtacggctacgcgactttccctcccacaaaccctcgcgcccttcctttcctacttgggcccggcagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20512 - RNA, 1554 nt, synthetic construct
  misc_feature 1..1554: note = mRNA product Design h-1 comprising derived and/or modified sequence from HRSV(Memphis-37)__AIY60635.1__N (opt2)
  source 1..1554: mol_type = other RNA
gggagacccgtgacccggaagttgtacggctacgcgactttccctcccacaaaccctcgcgcccttcctttcctacttgggcccggcagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20513 - RNA, 1554 nt, synthetic construct
  misc_feature 1..1554: note = mRNA product Design h-1 comprising derived and/or modified sequence from HRSV(Memphis-37)__AIY60635.1__N (opt3)
  source 1..1554: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20514 - RNA, 1554 nt, synthetic construct
  misc_feature 1..1554: note = mRNA product Design h-1 comprising derived and/or modified sequence from HRSV(Memphis-37)__AIY60635.1__N (opt4)
  source 1..1554: mol_type = other RNA
gggagacccgtgacccggaagttgtacggctacgcgactttccctcccacaaaccctcgcgcccttcctttcctacttgggcccggcagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20515 - RNA, 1554 nt, synthetic construct
  misc_feature 1..1554: note = mRNA product Design h-1 comprising derived and/or modified sequence from HRSV(Memphis-37)__AIY60635.1__N (opt5)
  source 1..1554: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20516 - RNA, 1554 nt, synthetic construct
  misc_feature 1..1554: note = mRNA product Design h-1 comprising derived and/or modified sequence from HRSV(Memphis-37)__AIY60635.1__N (opt6)
  source 1..1554: mol_type = other RNA
gggagacccgtgacccggaagttgtacggctacgcgactttccctcccacaaaccctcgcgcccttcctttcctacttgggcccggcagaaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20517 - RNA, 1554 nt, synthetic construct
  misc_feature 1..1554: note = mRNA product Design h-1 comprising derived and/or modified sequence from HRSV(Memphis-37)__AIY60635.1__N (opt11)
  source 1..1554: mol_type = other RNA
gggagacccgtgacccggaagttgtacggctacgcgactttccctcccacaaaccctcgcgcccttcctttcctacttgggcccggcagaaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20518 - RNA, 1770 nt, synthetic construct
  misc_feature 1..1770: note = mRNA product Design h-2 comprising derived and/or modified sequence from HRSV(Memphis-37)__AIY60635.1__N (wt)
  source 1..1770: mol_type = other RNA
gggagacccgtgacccggaagttgtacggctacgcgactttccctcccacaaaccctcgcgcccttcctttcctacttgggcccggcagaaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20519 - RNA, 1770 nt, synthetic construct
  misc_feature 1..1770: note = mRNA product Design h-2 comprising derived and/or modified sequence from HRSV(Memphis-37)__AIY60635.1__N (opt1)
  source 1..1770: mol_type = other RNA
gggagacccgtgacccggaagttgtacggctacgcgactttccctcccacaaaccctcgcgcccttcctttcctacttgggcccggcagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20520 - RNA, 1770 nt, synthetic construct
  misc_feature 1..1770: note = mRNA product Design h-2 comprising derived and/or modified sequence from HRSV(Memphis-37)__AIY60635.1__N (opt2)
  source 1..1770: mol_type = other RNA
gggagacccgtgacccggaagttgtacggctacgcgactttccctcccacaaaccctcgcgcccttcctttcctacttgggcccggcagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20521 - RNA, 1770 nt, synthetic construct
  misc_feature 1..1770: note = mRNA product Design h-2 comprising derived and/or modified sequence from HRSV(Memphis-37)__AIY60635.1__N (opt3)
  source 1..1770: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20522 - RNA, 1770 nt, synthetic construct
  misc_feature 1..1770: note = mRNA product Design h-2 comprising derived and/or modified sequence from HRSV(Memphis-37)__AIY60635.1__N (opt4)
  source 1..1770: mol_type = other RNA
gggagacccgtgacccggaagttgtacggctacgcgactttccctcccacaaaccctcgcgcccttcctttcctacttgggcccggcagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20523 - RNA, 1770 nt, synthetic construct
  misc_feature 1..1770: note = mRNA product Design h-2 comprising derived and/or modified sequence from HRSV(Memphis-37)__AIY60635.1__N (opt5)
  source 1..1770: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20524 - RNA, 1770 nt, synthetic construct
  misc_feature 1..1770: note = mRNA product Design h-2 comprising derived and/or modified sequence from HRSV(Memphis-37)__AIY60635.1__N (opt6)
  source 1..1770: mol_type = other RNA
gggagacccgtgacccggaagttgtacggctacgcgactttccctcccacaaaccctcgcgcccttcctttcctacttgggcccggcagaaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20525 - RNA, 1770 nt, synthetic construct
  misc_feature 1..1770: note = mRNA product Design h-2 comprising derived and/or modified sequence from HRSV(Memphis-37)__AIY60635.1__N (opt11)
  source 1..1770: mol_type = other RNA
gggagacccgtgacccggaagttgtacggctacgcgactttccctcccacaaaccctcgcgcccttcctttcctacttgggcccggcagaaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20526 - RNA, 1550 nt, synthetic construct
  misc_feature 1..1550: note = mRNA product Design h-3 comprising derived and/or modified sequence from HRSV(Memphis-37)__AIY60635.1__N (wt)
  source 1..1550: mol_type = other RNA
gggagacccgtgacccggaagttgtacggctacgcgactttccctcccacaaaccctcgcgcccttcctttcctacttgggcccggcagaaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20527 - RNA, 1550 nt, synthetic construct
  misc_feature 1..1550: note = mRNA product Design h-3 comprising derived and/or modified sequence from HRSV(Memphis-37)__AIY60635.1__N (opt1)
  source 1..1550: mol_type = other RNA
gggagacccgtgacccggaagttgtacggctacgcgactttccctcccacaaaccctcgcgcccttcctttcctacttgggcccggcagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20528 - RNA, 1550 nt, synthetic construct
  misc_feature 1..1550: note = mRNA product Design h-3 comprising derived and/or modified sequence from HRSV(Memphis-37)__AIY60635.1__N (opt2)
  source 1..1550: mol_type = other RNA
gggagacccgtgacccggaagttgtacggctacgcgactttccctcccacaaaccctcgcgcccttcctttcctacttgggcccggcagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20529 - RNA, 1550 nt, synthetic construct
  misc_feature 1..1550: note = mRNA product Design h-3 comprising derived and/or modified sequence from HRSV(Memphis-37)__AIY60635.1__N (opt3)
  source 1..1550: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20530 - RNA, 1550 nt, synthetic construct
  misc_feature 1..1550: note = mRNA product Design h-3 comprising derived and/or modified sequence from HRSV(Memphis-37)__AIY60635.1__N (opt4)
  source 1..1550: mol_type = other RNA
gggagacccgtgacccggaagttgtacggctacgcgactttccctcccacaaaccctcgcgcccttcctttcctacttgggcccggcagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20531 - RNA, 1550 nt, synthetic construct
  misc_feature 1..1550: note = mRNA product Design h-3 comprising derived and/or modified sequence from HRSV(Memphis-37)__AIY60635.1__N (opt5)
  source 1..1550: mol_type = other RNA
gggagacccgtgacccggaagttgtacggctacgcgactttccctcccacaaaccctcgcgcccttcctttcctacttgggcccggcagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20532 - RNA, 1550 nt, synthetic construct
  misc_feature 1..1550: note = mRNA product Design h-3 comprising derived and/or modified sequence from HRSV(Memphis-37)__AIY60635.1__N (opt6)
  source 1..1550: mol_type = other RNA
gggagacccgtgacccggaagttgtacggctacgcgactttccctcccacaaaccctcgcgcccttcctttcctacttgggcccggcagaaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20533 - RNA, 1550 nt, synthetic construct
  misc_feature 1..1550: note = mRNA product Design h-3 comprising derived and/or modified sequence from HRSV(Memphis-37)__AIY60635.1__N (opt11)
  source 1..1550: mol_type = other RNA
gggagacccgtgacccggaagttgtacggctacgcgactttccctcccacaaaccctcgcgcccttcctttcctacttgggcccggcagaaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20534 - RNA, 1613 nt, synthetic construct
  misc_feature 1..1613: note = mRNA product Design h-4 comprising derived and/or modified sequence from HRSV(Memphis-37)__AIY60635.1__N (wt)
  source 1..1613: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20535 - RNA, 1613 nt, synthetic construct
  misc_feature 1..1613: note = mRNA product Design h-4 comprising derived and/or modified sequence from HRSV(Memphis-37)__AIY60635.1__N (opt1)
  source 1..1613: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20536 - RNA, 1613 nt, synthetic construct
  misc_feature 1..1613: note = mRNA product Design h-4 comprising derived and/or modified sequence from HRSV(Memphis-37)__AIY60635.1__N (opt2)
  source 1..1613: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20537 - RNA, 1613 nt, synthetic construct
  misc_feature 1..1613: note = mRNA product Design h-4 comprising derived and/or modified sequence from HRSV(Memphis-37)__AIY60635.1__N (opt3)
  source 1..1613: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20538 - RNA, 1613 nt, synthetic construct
  misc_feature 1..1613: note = mRNA product Design h-4 comprising derived and/or modified sequence from HRSV(Memphis-37)__AIY60635.1__N (opt4)
  source 1..1613: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20539 - RNA, 1613 nt, synthetic construct
  misc_feature 1..1613: note = mRNA product Design h-4 comprising derived and/or modified sequence from HRSV(Memphis-37)__AIY60635.1__N (opt5)
  source 1..1613: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20540 - RNA, 1613 nt, synthetic construct
  misc_feature 1..1613: note = mRNA product Design h-4 comprising derived and/or modified sequence from HRSV(Memphis-37)__AIY60635.1__N (opt6)
  source 1..1613: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20541 - RNA, 1613 nt, synthetic construct
  misc_feature 1..1613: note = mRNA product Design h-4 comprising derived and/or modified sequence from HRSV(Memphis-37)__AIY60635.1__N (opt11)
  source 1..1613: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20542 - RNA, 1629 nt, synthetic construct
  misc_feature 1..1629: note = mRNA product Design h-5 comprising derived and/or modified sequence from HRSV(Memphis-37)__AIY60635.1__N (wt)
  source 1..1629: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20543 - RNA, 1629 nt, synthetic construct
  misc_feature 1..1629: note = mRNA product Design h-5 comprising derived and/or modified sequence from HRSV(Memphis-37)__AIY60635.1__N (opt1)
  source 1..1629: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20544 - RNA, 1629 nt, synthetic construct
  misc_feature 1..1629: note = mRNA product Design h-5 comprising derived and/or modified sequence from HRSV(Memphis-37)__AIY60635.1__N (opt2)
  source 1..1629: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20545 - RNA, 1629 nt, synthetic construct
  misc_feature 1..1629: note = mRNA product Design h-5 comprising derived and/or modified sequence from HRSV(Memphis-37)__AIY60635.1__N (opt3)
  source 1..1629: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20546 - RNA, 1629 nt, synthetic construct
  misc_feature 1..1629: note = mRNA product Design h-5 comprising derived and/or modified sequence from HRSV(Memphis-37)__AIY60635.1__N (opt4)
  source 1..1629: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20547 - RNA, 1629 nt, synthetic construct
  misc_feature 1..1629: note = mRNA product Design h-5 comprising derived and/or modified sequence from HRSV(Memphis-37)__AIY60635.1__N (opt5)
  source 1..1629: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20548 - RNA, 1629 nt, synthetic construct
  misc_feature 1..1629: note = mRNA product Design h-5 comprising derived and/or modified sequence from HRSV(Memphis-37)__AIY60635.1__N (opt6)
  source 1..1629: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20549 - RNA, 1629 nt, synthetic construct
  misc_feature 1..1629: note = mRNA product Design h-5 comprising derived and/or modified sequence from HRSV(Memphis-37)__AIY60635.1__N (opt11)
  source 1..1629: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20550 - RNA, 1562 nt, synthetic construct
  misc_feature 1..1562: note = mRNA product Design i-1 comprising derived and/or modified sequence from HRSV(Memphis-37)__AIY60635.1__N (wt)
  source 1..1562: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20551 - RNA, 1562 nt, synthetic construct
  misc_feature 1..1562: note = mRNA product Design i-1 comprising derived and/or modified sequence from HRSV(Memphis-37)__AIY60635.1__N (opt1)
  source 1..1562: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20552 - RNA, 1562 nt, synthetic construct
  misc_feature 1..1562: note = mRNA product Design i-1 comprising derived and/or modified sequence from HRSV(Memphis-37)__AIY60635.1__N (opt2)
  source 1..1562: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20553 - RNA, 1562 nt, synthetic construct
  misc_feature 1..1562: note = mRNA product Design i-1 comprising derived and/or modified sequence from HRSV(Memphis-37)__AIY60635.1__N (opt3)
  source 1..1562: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20554 - RNA, 1562 nt, synthetic construct
  misc_feature 1..1562: note = mRNA product Design i-1 comprising derived and/or modified sequence from HRSV(Memphis-37)__AIY60635.1__N (opt4)
  source 1..1562: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20555 - RNA, 1562 nt, synthetic construct
  misc_feature 1..1562: note = mRNA product Design i-1 comprising derived and/or modified sequence from HRSV(Memphis-37)__AIY60635.1__N (opt5)
  source 1..1562: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20556 - RNA, 1562 nt, synthetic construct
  misc_feature 1..1562: note = mRNA product Design i-1 comprising derived and/or modified sequence from HRSV(Memphis-37)__AIY60635.1__N (opt6)
  source 1..1562: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20557 - RNA, 1562 nt, synthetic construct
  misc_feature 1..1562: note = mRNA product Design i-1 comprising derived and/or modified sequence from HRSV(Memphis-37)__AIY60635.1__N (opt11)
  source 1..1562: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20558 - RNA, 1562 nt, synthetic construct
  misc_feature 1..1562: note = mRNA product Design i-2 comprising derived and/or modified sequence from HRSV(Memphis-37)__AIY60635.1__N (wt)
  source 1..1562: mol_type = other RNA
gggagaggcgctgcctacggaggtggcagccatctccttctcggcatcaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20559 - RNA, 1562 nt, synthetic construct
  misc_feature 1..1562: note = mRNA product Design i-2 comprising derived and/or modified sequence from HRSV(Memphis-37)__AIY60635.1__N (opt1)
  source 1..1562: mol_type = other RNA
gggagaggcgctgcctacggaggtggcagccatctccttctcggcatcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20560 - RNA, 1562 nt, synthetic construct
  misc_feature 1..1562: note = mRNA product Design i-2 comprising derived and/or modified sequence from HRSV(Memphis-37)__AIY60635.1__N (opt2)
  source 1..1562: mol_type = other RNA
gggagaggcgctgcctacggaggtggcagccatctccttctcggcatcaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20561 - RNA, 1562 nt, synthetic construct
  misc_feature 1..1562: note = mRNA product Design i-2 comprising derived and/or modified sequence from HRSV(Memphis-37)__AIY60635.1__N (opt3)
  source 1..1562: mol_type = other RNA
gggagaggcgctgcctacggaggtggcagccatctccttctcggcatcaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20562 - RNA, 1562 nt, synthetic construct
  misc_feature 1..1562: note = mRNA product Design i-2 comprising derived and/or modified sequence from HRSV(Memphis-37)__AIY60635.1__N (opt4)
  source 1..1562: mol_type = other RNA
gggagaggcgctgcctacggaggtggcagccatctccttctcggcatcaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20563 - RNA, 1562 nt, synthetic construct
  misc_feature 1..1562: note = mRNA product Design i-2 comprising derived and/or modified sequence from HRSV(Memphis-37)__AIY60635.1__N (opt5)
  source 1..1562: mol_type = other RNA
gggagaggcgctgcctacggaggtggcagccatctccttctcggcatcaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20564 - RNA, 1562 nt, synthetic construct
  misc_feature 1..1562: note = mRNA product Design i-2 comprising derived and/or modified sequence from HRSV(Memphis-37)__AIY60635.1__N (opt6)
  source 1..1562: mol_type = other RNA
gggagaggcgctgcctacggaggtggcagccatctccttctcggcatcaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20565 - RNA, 1562 nt, synthetic construct
  misc_feature 1..1562: note = mRNA product Design i-2 comprising derived and/or modified sequence from HRSV(Memphis-37)__AIY60635.1__N (opt11)
  source 1..1562: mol_type = other RNA
gggagaggcgctgcctacggaggtggcagccatctccttctcggcatcaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20566 - RNA, 1558 nt, synthetic construct
  misc_feature 1..1558: note = mRNA product Design i-2 comprising derived and/or modified sequence from HRSV(Memphis-37)__AIY60635.1__N (wt)
  source 1..1558: mol_type = other RNA
ggggcgctgcctacggaggtggcagccatctccttctcggcatcaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20567 - RNA, 1558 nt, synthetic construct
  misc_feature 1..1558: note = mRNA product Design i-2 comprising derived and/or modified sequence from HRSV(Memphis-37)__AIY60635.1__N (opt1)
  source 1..1558: mol_type = other RNA
ggggcgctgcctacggaggtggcagccatctccttctcggcatcaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20568 - RNA, 1558 nt, synthetic construct
  misc_feature 1..1558: note = mRNA product Design i-2 comprising derived and/or modified sequence from HRSV(Memphis-37)__AIY60635.1__N (opt2)
  source 1..1558: mol_type = other RNA
ggggcgctgcctacggaggtggcagccatctccttctcggcatcaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20569 - RNA, 1558 nt, synthetic construct
  misc_feature 1..1558: note = mRNA product Design i-2 comprising derived and/or modified sequence from HRSV(Memphis-37)__AIY60635.1__N (opt3)
  source 1..1558: mol_type = other RNA
ggggcgctgcctacggaggtggcagccatctccttctcggcatcaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20570 - RNA, 1558 nt, synthetic construct
  misc_feature 1..1558: note = mRNA product Design i-2 comprising derived and/or modified sequence from HRSV(Memphis-37)__AIY60635.1__N (opt4)
  source 1..1558: mol_type = other RNA
ggggcgctgcctacggaggtggcagccatctccttctcggcatcaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20571 - RNA, 1558 nt, synthetic construct
  misc_feature 1..1558: note = mRNA product Design i-2 comprising derived and/or modified sequence from HRSV(Memphis-37)__AIY60635.1__N (opt5)
  source 1..1558: mol_type = other RNA
ggggcgctgcctacggaggtggcagccatctccttctcggcatcaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20572 - RNA, 1558 nt, synthetic construct
  misc_feature 1..1558: note = mRNA product Design i-2 comprising derived and/or modified sequence from HRSV(Memphis-37)__AIY60635.1__N (opt6)
  source 1..1558: mol_type = other RNA
ggggcgctgcctacggaggtggcagccatctccttctcggcatcaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20573 - RNA, 1558 nt, synthetic construct
  misc_feature 1..1558: note = mRNA product Design i-2 comprising derived and/or modified sequence from HRSV(Memphis-37)__AIY60635.1__N (opt11)
  source 1..1558: mol_type = other RNA
ggggcgctgcctacggaggtggcagccatctccttctcggcatcaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20574 - RNA, 1393 nt, synthetic construct
  misc_feature 1..1393: note = mRNA product Design i-3 comprising derived and/or modified sequence from HRSV(Memphis-37)__AIY60635.1__N (wt)
  source 1..1393: mol_type = other RNA
gggagaaagcttaccatggctcttagcaaagtcaagttgaacgatacactcaacaaagatcaacttctgtcatccagcaaatacaccatccaacggagcacaggagatagtattgatactcctaattatgatgtgcagaaacacatcaacaagttatgtggcatgttattaatcacagaagatgctaatcataaattcactggggtaataggtatgttatatgctatgtctagattaggaagagaagacaccataaaaatactcagagatgcgggatatcatgtaaaagcaaatggagtggatgtaacaacacatcgtcaagacattaatggaaaagaaatgaaatttgaagtgttaacattggcaagcttaacaactgaaattcaaatcaacattgagatagaatctaggaaatcctacaaaaaaatgctaaaagaaatgggagaggtggctccagaatacaggcatgactctcctgattgtggaatgataatattatgtatagcagcattagtaataaccaaattagcagcaggggatagatctggtcttactgctgtgattaggagagctaataatgttctaaaaaatgaaatgaaacgttataaaggcttactaccaaaggatatagccaacagcttctatgaagtgtttgaaaaatatcctcactttatagatgtttttgttcattttggtatagcacaatcttctaccagaggtggcagtagagttgaagggatttttgcaggattgtttatgaatgcctatggtgcagggcaagtgatgttacggtggggagtcttagcaaaatcagttaaaaatattatgctaggacatgctagtgtgcaagcagaaatggaacaagttgtggaagtttatgaatatgcccaaaaattgggtggagaagcaggattctaccatatattgaacaatccaaaagcatcattattatctttgactcaatttccccacttctccagtgtagtattgggcaatgctgctggcctaggcataatgggagaatacagaggtacaccaaggaatcaagatctatatgatgctgcaaaggcatatgctgaacaactcaaagaaaatggtgtgattaactacagtgtattagacttgacagcagaagaactagaggctatcaaacatcagcttaatccaaaagataatgatgtagagctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20575 - RNA, 1393 nt, synthetic construct
  misc_feature 1..1393: note = mRNA product Design i-3 comprising derived and/or modified sequence from HRSV(Memphis-37)__AIY60635.1__N (opt1)
  source 1..1393: mol_type = other RNA
gggagaaagcttaccatggccctgagcaaggtgaagctcaacgacaccctgaacaaggaccagctgctctccagctccaagtacaccatccagcgcagcaccggcgactccatcgacacccccaactacgacgtccagaagcacatcaacaagctgtgcgggatgctgctcatcaccgaggacgccaaccacaagttcaccggcgtgatcgggatgctgtacgcgatgagccggctgggccgcgaggacacgatcaagatcctccgggacgccgggtaccacgtgaaggccaacggcgtcgacgtgaccacccaccgccaggacatcaacggcaaggagatgaagttcgaggtgctgaccctggcctccctcacgaccgagatccagatcaacatcgagatcgagagccggaagtcctacaagaagatgctgaaggagatgggggaggtcgccccggagtaccgccacgacagccccgactgcggcatgatcatcctgtgcatcgcggccctcgtgatcaccaagctggccgccggggaccggtccggcctgaccgcggtgatccgccgggccaacaacgtcctcaagaacgagatgaagcgctacaaggggctgctgcccaaggacatcgccaacagcttctacgaggtgttcgagaagtacccccacttcatcgacgtgttcgtccacttcggcatcgcccagtccagcacgcggggcgggtcccgcgtggagggcatcttcgccgggctgttcatgaacgcgtacggcgccggccaggtgatgctgcggtggggcgtcctggccaagagcgtgaagaacatcatgctcgggcacgcctccgtgcaggccgagatggagcaggtcgtggaggtgtacgagtacgcgcagaagctcgggggcgaggccgggttctaccacatcctgaacaacccgaaggccagcctcctgtccctgacccagttcccccacttcagcagcgtcgtgctcggcaacgccgccggcctggggatcatgggcgagtaccgcgggacgccccggaaccaggacctgtacgacgcggccaaggcctacgccgagcagctcaaggagaacggcgtgatcaactactccgtcctggacctgaccgccgaggagctcgaggcgatcaagcaccagctgaaccccaaggacaacgacgtggagctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20576 - RNA, 1393 nt, synthetic construct
  misc_feature 1..1393: note = mRNA product Design i-3 comprising derived and/or modified sequence from HRSV(Memphis-37)__AIY60635.1__N (opt2)
  source 1..1393: mol_type = other RNA
gggagaaagcttaccatggccctctccaaggtcaagctcaacgacaccctcaacaaggaccagctcctctcctcctccaagtacaccatccagcgctccaccggcgactccatcgacacccccaactacgacgtccagaagcacatcaacaagctctgcggcatgctcctcatcaccgaggacgccaaccacaagttcaccggcgtcatcggcatgctctacgccatgtcccgcctcggccgcgaggacaccatcaagatcctccgcgacgccggctaccacgtcaaggccaacggcgtcgacgtcaccacccaccgccaggacatcaacggcaaggagatgaagttcgaggtcctcaccctcgcctccctcaccaccgagatccagatcaacatcgagatcgagtcccgcaagtcctacaagaagatgctcaaggagatgggcgaggtcgcccccgagtaccgccacgactcccccgactgcggcatgatcatcctctgcatcgccgccctcgtcatcaccaagctcgccgccggcgaccgctccggcctcaccgccgtcatccgccgcgccaacaacgtcctcaagaacgagatgaagcgctacaagggcctcctccccaaggacatcgccaactccttctacgaggtcttcgagaagtacccccacttcatcgacgtcttcgtccacttcggcatcgcccagtcctccacccgcggcggctcccgcgtcgagggcatcttcgccggcctcttcatgaacgcctacggcgccggccaggtcatgctccgctggggcgtcctcgccaagtccgtcaagaacatcatgctcggccacgcctccgtccaggccgagatggagcaggtcgtcgaggtctacgagtacgcccagaagctcggcggcgaggccggcttctaccacatcctcaacaaccccaaggcctccctcctctccctcacccagttcccccacttctcctccgtcgtcctcggcaacgccgccggcctcggcatcatgggcgagtaccgcggcaccccccgcaaccaggacctctacgacgccgccaaggcctacgccgagcagctcaaggagaacggcgtcatcaactactccgtcctcgacctcaccgccgaggagctcgaggccatcaagcaccagctcaaccccaaggacaacgacgtcgagctctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20577 - RNA, 1393 nt, synthetic construct
  misc_feature 1..1393: note = mRNA product Design i-3 comprising derived and/or modified sequence from HRSV(Memphis-37)__AIY60635.1__N (opt3)
  source 1..1393: mol_type = other RNA
gggagaaagcttaccatggccctgagcaaggtgaaactcaacgacacccttaataaggatcagctgttgtcctcttcaaaatacacaatccaaagaagtactggcgacagcattgatacgcccaactatgacgtccagaagcacataaataaattatgcgggatgctgctaatcaccgaggatgctaaccataagttcacaggagttattggtatgctctacgcaatgtccaggctgggccgggaagacactatcaagattcttcgcgatgccgggtatcacgtgaaagcgaatggagtagacgtgaccacacatcgacaggatatcaacggcaaggagatgaaatttgaagtcctgaccttggcttctctcactacagagatacagatcaatattgaaatcgagtcgcgtaagtcatacaaaaagatgctgaaggagatgggtgaagtggcccctgagtatagacacgacagcccagattgtgggatgattatcctgtgcatagcagccctcgttattaccaaattagctgcaggagacaggagtggcctgacggccgtgatccggcgcgctaacaatgtccttaagaacgaaatgaaaagatacaagggcttgctgccgaaagatattgccaattccttctatgaggtgtttgagaagtacccccatttcatcgacgtatttgttcacttcgggatcgcgcaatctagcactaggggaggttcccgggtggaaggcatttttgcagggctattcatgaacgcctacggagctggccaggtcatgctccgctggggtgtgctggccaaatcagtgaagaatataatgcttgggcacgcaagtgtccaggctgagatggaacaggttgtggaggtatatgaatacgcccaaaagctgggaggcgaggcgggcttttatcatatcttgaacaatcctaaagccagcctcctgtctttaacccagttcccacacttttcctcagtggtcctggggaacgcagctggactcggtattatgggcgagtaccgagggacacccagaaaccaggacctttatgatgccgctaaggcctacgcagaacagctgaaagagaatggagtgatcaactatagcgttttggacctaactgccgaggaactggaagctataaagcatcaactcaatcctaaagataacgacgtggagctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20578 - RNA, 1393 nt, synthetic construct
  misc_feature 1..1393: note = mRNA product Design i-3 comprising derived and/or modified sequence from HRSV(Memphis-37)__AIY60635.1__N (opt4)
  source 1..1393: mol_type = other RNA
gggagaaagcttaccatggccctgagcaaggtgaagctgaacgacaccctgaacaaggaccagctgctgagcagcagcaagtacaccatccagagaagcaccggcgacagcatcgacacccccaactacgacgtgcagaagcacatcaacaagctgtgcggcatgctgctgatcaccgaggacgccaaccacaagttcaccggcgtgatcggcatgctgtacgccatgagcagactgggcagagaggacaccatcaagatcctgagagacgccggctaccacgtgaaggccaacggcgtggacgtgaccacccacagacaggacatcaacggcaaggagatgaagttcgaggtgctgaccctggccagcctgaccaccgagatccagatcaacatcgagatcgagagcagaaagagctacaagaagatgctgaaggagatgggcgaggtggcccccgagtacagacacgacagccccgactgcggcatgatcatcctgtgcatcgccgccctggtgatcaccaagctggccgccggcgacagaagcggcctgaccgccgtgatcagaagagccaacaacgtgctgaagaacgagatgaagagatacaagggcctgctgcccaaggacatcgccaacagcttctacgaggtgttcgagaagtacccccacttcatcgacgtgttcgtgcacttcggcatcgcccagagcagcaccagaggcggcagcagagtggagggcatcttcgccggcctgttcatgaacgcctacggcgccggccaggtgatgctgagatggggcgtgctggccaagagcgtgaagaacatcatgctgggccacgccagcgtgcaggccgagatggagcaggtggtggaggtgtacgagtacgcccagaagctgggcggcgaggccggcttctaccacatcctgaacaaccccaaggccagcctgctgagcctgacccagttcccccacttcagcagcgtggtgctgggcaacgccgccggcctgggcatcatgggcgagtacagaggcacccccagaaaccaggacctgtacgacgccgccaaggcctacgccgagcagctgaaggagaacggcgtgatcaactacagcgtgctggacctgaccgccgaggagctggaggccatcaagcaccagctgaaccccaaggacaacgacgtggagctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20579 - RNA, 1393 nt, synthetic construct
  misc_feature 1..1393: note = mRNA product Design i-3 comprising derived and/or modified sequence from HRSV(Memphis-37)__AIY60635.1__N (opt5)
  source 1..1393: mol_type = other RNA
gggagaaagcttaccatggccctgagcaaggtgaaactcaacgacaccctgaataaggatcagcttctgtcctctagcaaatacacaatccaaagatccacgggcgactctattgatacccccaactatgacgtccagaagcacatcaataaactctgcgggatgctgcttattacagaggatgctaaccataagttcaccggagttatcggcatgctgtacgccatgagccggctcgggcgcgaagacacaattaagatcctgagagatgcgggatatcacgtgaaagctaatggcgtggacgtcaccacacatcggcaggatatcaacgggaaggagatgaaatttgaagtgctgaccctcgcctccctgacgaccgagattcagatcaatattgaaatcgagtctcgcaagagctacaaaaagatgcttaaggagatgggagaagttgcccctgagtatagacacgactccccggattgtggcatgattatcctgtgcattgctgccctcgtgatcacaaaactggctgccggcgaccggagcgggcttaccgcggtcatccgcagagccaacaatgtgctgaagaacgaaatgaaacggtacaagggactcctgcccaaagatattgctaattctttctatgaggtttttgagaagtaccctcatttcatcgacgtgtttgtccacttcggcattgcccaatccagcacacgcgggggatctagagtggaaggcatctttgctgggctgttcatgaacgcctacggagcgggccaggtgatgctccggtggggcgtcctggccaaatccgttaagaatattatgcttgggcacgctagcgtgcaggccgagatggaacaggtggtcgaggtgtatgaatacgctcaaaagctgggaggcgaggccgggttttatcatatcctcaacaatcccaaagcctctctgctttccctgacccagttccctcactttagctccgttgtgctcggaaacgctgcgggcctggggatcatgggagagtaccgcggcacgcccagaaaccaggacctgtatgatgccgctaaggcctacgccgaacagctcaaagagaatggcgtcattaactattctgtgctggaccttacagctgaggaactggaagccatcaagcatcaactcaatcctaaagataacgacgttgagctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20580 - RNA, 1393 nt, synthetic construct
  misc_feature 1..1393: note = mRNA product Design i-3 comprising derived and/or modified sequence from HRSV(Memphis-37)__AIY60635.1__N (opt6)
  source 1..1393: mol_type = other RNA
gggagaaagcttaccatggccttaagtaaagtaaaattaaacgacacactaaacaaagaccaattactctcatcatcgaaatatacaatacaaagatccacaggagactccatagatacaccaaattacgacgtacaaaaacatataaacaaactctgcggaatgttattaataacagaagacgcaaaccacaaattcacaggagtcataggtatgctatacgcaatgtcaagattaggaagagaagatacaataaaaatactaagagacgcaggataccacgtaaaagcaaacggagtagacgtaacaacacatagacaagatataaacggtaaagaaatgaaattcgaagtactaacactagccagtctaacaacagaaatacaaataaacatagaaatagaaagccgaaaatcatacaaaaaaatgttaaaagaaatgggggaagtagcacccgaatacagacatgattcacctgactgcggaatgataatactctgcatagcggcattagtcataacaaaactagccgcaggagacagaagcggattaacagcagtaataagaagagcaaataatgtattaaaaaatgaaatgaaaaggtataaaggattactaccaaaagatatagcaaactcattctatgaagttttcgaaaaatacccacacttcatagacgtcttcgtacactttggaatagcacaaagcagcacaagaggaggaagcagagtagaaggaatattcgcaggactattcatgaatgcatacggagccggacaagtaatgctaagatggggagttttagcaaaaagcgtaaaaaacataatgttaggacacgcctccgtccaagccgaaatggaacaagtagtagaagtatacgaatatgcacaaaaactaggaggagaagcaggattctatcacatactcaataacccaaaagcatcactattgagcttaacacaattcccacatttttcatccgtagtcctaggaaatgcagcaggcttaggaataatgggagaatacagaggcacaccaagaaatcaagacttatacgatgcagcaaaagcatacgcagaacaactaaaagaaaacggagtaataaactactcagtattagatttaacagcagaagaattagaagcaataaaacatcaactaaatcctaaggataatgatgtagaactctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20581 - RNA, 1393 nt, synthetic construct
  misc_feature 1..1393: note = mRNA product Design i-3 comprising derived and/or modified sequence from HRSV(Memphis-37)__AIY60635.1__N (opt11)
  source 1..1393: mol_type = other RNA
gggagaaagcttaccatggccctaagcaaagtcaaactcaacgacacactaaacaaagaccaactcctcagctccagcaaatacaccatccaacgatccaccggcgactccatagacacccccaactacgacgtccaaaaacacatcaacaaactatgcggcatgctcctaatcacagaagacgccaaccacaaattcaccggagtcatcggcatgctctacgccatgagccgcctcggccgagaagacacaatcaaaatactaagagacgccggctaccacgtaaaagccaacggcgtagacgtaaccacccaccgccaagacatcaacggcaaagaaatgaaattcgaagttctcaccctcgcctcactaaccacggaaatccaaataaacattgaaatcgaaagcagaaaatcctacaaaaagatgctaaaagaaatgggcgaggtagccccagaataccgccacgacagccccgactgcggaatgatcatcctctgcattgcagccctcgtcatcaccaaactagccgccggcgacagaagcggcctaaccgcagtaatccgccgagccaacaacgtactcaaaaacgaaatgaaacgctacaaaggcctcctccccaaagacatcgccaacagcttctacgaagtattcgaaaaatacccgcacttcatcgacgtcttcgtacacttcggcatagcccaaagcagcacacgaggcggctcccgcgtcgaaggaatattcgccggcctgttcatgaacgcatacggagcgggccaagtcatgctccgctggggtgtactagccaagtccgtcaaaaacatcatgctagggcacgcaagcgtacaagccgaaatggaacaagtagtcgaagtctacgaatacgcacaaaaactaggcggcgaagccggcttctaccacatcctaaacaaccccaaagcctcattactctccctcacccaatttcctcacttctccagcgtcgtcctcggaaacgccgccggcctaggcataatgggggaataccgcggcaccccgcgcaaccaagacctctacgacgcagcaaaagcctacgcagaacaactaaaagaaaacggagtcatcaactacagcgtactggacctaaccgccgaagaactcgaagccataaaacaccaactcaaccccaaagacaacgacgtcgagctctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20582 - protein, 241 aa, synthetic construct; identical to SEQ ID NO: 11006
  REGION 1..241: note = derived and/or modified protein sequence (wt) from HRSV(Memphis-37)__AIY60637.1__P

SEQ ID NO: 20583 - RNA, 726 nt, synthetic construct
  misc_feature 1..726: note = derived and/or modified CDS sequence (wt) from HRSV(Memphis-37)__AIY60637.1__P
  source 1..726: mol_type = other RNA
atggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctga

SEQ ID NO: 20584 - RNA, 726 nt, synthetic construct
  misc_feature 1..726: note = derived and/or modified CDS sequence (opt1) from HRSV(Memphis-37)__AIY60637.1__P
  source 1..726: mol_type = other RNA
atggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctga

SEQ ID NO: 20585 - RNA, 726 nt, synthetic construct
  misc_feature 1..726: note = derived and/or modified CDS sequence (opt2) from HRSV(Memphis-37)__AIY60637.1__P
  source 1..726: mol_type = other RNA
atggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctga

SEQ ID NO: 20586 - RNA, 726 nt, synthetic construct
  misc_feature 1..726: note = derived and/or modified CDS sequence (opt3) from HRSV(Memphis-37)__AIY60637.1__P
  source 1..726: mol_type = other RNA
atggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttga

SEQ ID NO: 20587 - RNA, 726 nt, synthetic construct
  misc_feature 1..726: note = derived and/or modified CDS sequence (opt4) from HRSV(Memphis-37)__AIY60637.1__P
  source 1..726: mol_type = other RNA
atggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctga

SEQ ID NO: 20588 - RNA, 726 nt, synthetic construct
  misc_feature 1..726: note = derived and/or modified CDS sequence (opt5) from HRSV(Memphis-37)__AIY60637.1__P
  source 1..726: mol_type = other RNA
atggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttga

SEQ ID NO: 20589 - RNA, 726 nt, synthetic construct
  misc_feature 1..726: note = derived and/or modified CDS sequence (opt6) from HRSV(Memphis-37)__AIY60637.1__P
  source 1..726: mol_type = other RNA
atggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaa

SEQ ID NO: 20590 - RNA, 726 nt, synthetic construct
  misc_feature 1..726: note = derived and/or modified CDS sequence (opt11) from HRSV(Memphis-37)__AIY60637.1__P
  source 1..726: mol_type = other RNA
atggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaa

SEQ ID NO: 20591 - RNA, 1002 nt, synthetic construct
  misc_feature 1..1002: note = mRNA product Design a-1 comprising derived and/or modified sequence from HRSV(Memphis-37)__AIY60637.1__P (wt)
  source 1..1002: mol_type = other RNA
gggagagtcccgcagtcggcgtccagcggctctgcttgttcgtgtgtgtgtcgttgcaggccttattcaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20592 - RNA, 1002 nt, synthetic construct
  misc_feature 1..1002: note = mRNA product Design a-1 comprising derived and/or modified sequence from HRSV(Memphis-37)__AIY60637.1__P (opt1)
  source 1..1002: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20593 - RNA, 1002 nt, synthetic construct
  misc_feature 1..1002: note = mRNA product Design a-1 comprising derived and/or modified sequence from HRSV(Memphis-37)__AIY60637.1__P (opt2)
  source 1..1002: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20594 - RNA, 1002 nt, synthetic construct
  misc_feature 1..1002: note = mRNA product Design a-1 comprising derived and/or modified sequence from HRSV(Memphis-37)__AIY60637.1__P (opt3)
  source 1..1002: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20595 - RNA, 1002 nt, synthetic construct
  misc_feature 1..1002: note = mRNA product Design a-1 comprising derived and/or modified sequence from HRSV(Memphis-37)__AIY60637.1__P (opt4)
  source 1..1002: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20596 - RNA, 1002 nt, synthetic construct
  misc_feature 1..1002: note = mRNA product Design a-1 comprising derived and/or modified sequence from HRSV(Memphis-37)__AIY60637.1__P (opt5)
  source 1..1002: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20597 - RNA, 1002 nt, synthetic construct
  misc_feature 1..1002: note = mRNA product Design a-1 comprising derived and/or modified sequence from HRSV(Memphis-37)__AIY60637.1__P (opt6)
  source 1..1002: mol_type = other RNA
gggagagtcccgcagtcggcgtccagcggctctgcttgttcgtgtgtgtgtcgttgcaggccttattcaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20598 - RNA, 1002 nt, synthetic construct
  misc_feature 1..1002: note = mRNA product Design a-1 comprising derived and/or modified sequence from HRSV(Memphis-37)__AIY60637.1__P (opt11)
  source 1..1002: mol_type = other RNA
gggagagtcccgcagtcggcgtccagcggctctgcttgttcgtgtgtgtgtcgttgcaggccttattcaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20599 - RNA, 1021 nt, synthetic construct
  misc_feature 1..1021: note = mRNA product Design a-2 comprising derived and/or modified sequence from HRSV(Memphis-37)__AIY60637.1__P (wt)
  source 1..1021: mol_type = other RNA
gggagagtccgctcagccaggttgcagaagcggcttagcgtgtgtcctaatcttctctctgcgtgtaggtaggcctgtgccgcaaacaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20600 - RNA, 1021 nt, synthetic construct
  misc_feature 1..1021: note = mRNA product Design a-2 comprising derived and/or modified sequence from HRSV(Memphis-37)__AIY60637.1__P (opt1)
  source 1..1021: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20601 - RNA, 1021 nt, synthetic construct
  misc_feature 1..1021: note = mRNA product Design a-2 comprising derived and/or modified sequence from HRSV(Memphis-37)__AIY60637.1__P (opt2)
  source 1..1021: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20602 - RNA, 1021 nt, synthetic construct
  misc_feature 1..1021: note = mRNA product Design a-2 comprising derived and/or modified sequence from HRSV(Memphis-37)__AIY60637.1__P (opt3)
  source 1..1021: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20603 - RNA, 1021 nt, synthetic construct
  misc_feature 1..1021: note = mRNA product Design a-2 comprising derived and/or modified sequence from HRSV(Memphis-37)__AIY60637.1__P (opt4)
  source 1..1021: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20604 - RNA, 1021 nt, synthetic construct
  misc_feature 1..1021: note = mRNA product Design a-2 comprising derived and/or modified sequence from HRSV(Memphis-37)__AIY60637.1__P (opt5)
  source 1..1021: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20605 - RNA, 1021 nt, synthetic construct
  misc_feature 1..1021: note = mRNA product Design a-2 comprising derived and/or modified sequence from HRSV(Memphis-37)__AIY60637.1__P (opt6)
  source 1..1021: mol_type = other RNA
gggagagtccgctcagccaggttgcagaagcggcttagcgtgtgtcctaatcttctctctgcgtgtaggtaggcctgtgccgcaaacaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20606 - RNA, 1021 nt, synthetic construct
  misc_feature 1..1021: note = mRNA product Design a-2 comprising derived and/or modified sequence from HRSV(Memphis-37)__AIY60637.1__P (opt11)
  source 1..1021: mol_type = other RNA
gggagagtccgctcagccaggttgcagaagcggcttagcgtgtgtcctaatcttctctctgcgtgtaggtaggcctgtgccgcaaacaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20607 - RNA, 1099 nt, synthetic construct
  misc_feature 1..1099: note = mRNA product Design a-3 comprising derived and/or modified sequence from HRSV(Memphis-37)__AIY60637.1__P (wt)
  source 1..1099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20608 - RNA, 1099 nt, synthetic construct
  misc_feature 1..1099: note = mRNA product Design a-3 comprising derived and/or modified sequence from HRSV(Memphis-37)__AIY60637.1__P (opt1)
  source 1..1099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20609 - RNA, 1099 nt, synthetic construct
  misc_feature 1..1099: note = mRNA product Design a-3 comprising derived and/or modified sequence from HRSV(Memphis-37)__AIY60637.1__P (opt2)
  source 1..1099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20610 - RNA, 1099 nt, synthetic construct
  misc_feature 1..1099: note = mRNA product Design a-3 comprising derived and/or modified sequence from HRSV(Memphis-37)__AIY60637.1__P (opt3)
  source 1..1099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20611 - RNA, 1099 nt, synthetic construct
  misc_feature 1..1099: note = mRNA product Design a-3 comprising derived and/or modified sequence from HRSV(Memphis-37)__AIY60637.1__P (opt4)
  source 1..1099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20612 - RNA, 1099 nt, synthetic construct
  misc_feature 1..1099: note = mRNA product Design a-3 comprising derived and/or modified sequence from HRSV(Memphis-37)__AIY60637.1__P (opt5)
  source 1..1099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20613 - RNA, 1099 nt, synthetic construct
  misc_feature 1..1099: note = mRNA product Design a-3 comprising derived and/or modified sequence from HRSV(Memphis-37)__AIY60637.1__P (opt6)
  source 1..1099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20614 - RNA, 1099 nt, synthetic construct
  misc_feature 1..1099: note = mRNA product Design a-3 comprising derived and/or modified sequence from HRSV(Memphis-37)__AIY60637.1__P (opt11)
  source 1..1099: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20615 - RNA, 1048 nt, synthetic construct
  misc_feature 1..1048: note = mRNA product Design a-4 comprising derived and/or modified sequence from HRSV(Memphis-37)__AIY60637.1__P (wt)
  source 1..1048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20616 - RNA, 1048 nt, synthetic construct
  misc_feature 1..1048: note = mRNA product Design a-4 comprising derived and/or modified sequence from HRSV(Memphis-37)__AIY60637.1__P (opt1)
  source 1..1048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20617 - RNA, 1048 nt, synthetic construct
  misc_feature 1..1048: note = mRNA product Design a-4 comprising derived and/or modified sequence from HRSV(Memphis-37)__AIY60637.1__P (opt2)
  source 1..1048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20618 - RNA, 1048 nt, synthetic construct
  misc_feature 1..1048: note = mRNA product Design a-4 comprising derived and/or modified sequence from HRSV(Memphis-37)__AIY60637.1__P (opt3)
  source 1..1048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20619 - RNA, 1048 nt, synthetic construct
  misc_feature 1..1048: note = mRNA product Design a-4 comprising derived and/or modified sequence from HRSV(Memphis-37)__AIY60637.1__P (opt4)
  source 1..1048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20620 - RNA, 1048 nt, synthetic construct
  misc_feature 1..1048: note = mRNA product Design a-4 comprising derived and/or modified sequence from HRSV(Memphis-37)__AIY60637.1__P (opt5)
  source 1..1048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20621 - RNA, 1048 nt, synthetic construct
  misc_feature 1..1048: note = mRNA product Design a-4 comprising derived and/or modified sequence from HRSV(Memphis-37)__AIY60637.1__P (opt6)
  source 1..1048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20622 - RNA, 1048 nt, synthetic construct
  misc_feature 1..1048: note = mRNA product Design a-4 comprising derived and/or modified sequence from HRSV(Memphis-37)__AIY60637.1__P (opt11)
  source 1..1048: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20623 - RNA, 994 nt, synthetic construct
  misc_feature 1..994: note = mRNA product Design a-5 comprising derived and/or modified sequence from HRSV(Memphis-37)__AIY60637.1__P (wt)
  source 1..994: mol_type = other RNA
gggagactttcccattctgtagcagaatttggtgttgcctgtggtcttggtcccgcggagaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20624 - RNA, 994 nt, synthetic construct
  misc_feature 1..994: note = mRNA product Design a-5 comprising derived and/or modified sequence from HRSV(Memphis-37)__AIY60637.1__P (opt1)
  source 1..994: mol_type = other RNA
gggagactttcccattctgtagcagaatttggtgttgcctgtggtcttggtcccgcggagaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20625 - RNA, 994 nt, synthetic construct
  misc_feature 1..994: note = mRNA product Design a-5 comprising derived and/or modified sequence from HRSV(Memphis-37)__AIY60637.1__P (opt2)
  source 1..994: mol_type = other RNA
gggagactttcccattctgtagcagaatttggtgttgcctgtggtcttggtcccgcggagaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20626 - RNA, 994 nt, synthetic construct
  misc_feature 1..994: note = mRNA product Design a-5 comprising derived and/or modified sequence from HRSV(Memphis-37)__AIY60637.1__P (opt3)
  source 1..994: mol_type = other RNA
gggagactttcccattctgtagcagaatttggtgttgcctgtggtcttggtcccgcggagaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20627 - RNA, 994 nt, synthetic construct
  misc_feature 1..994: note = mRNA product Design a-5 comprising derived and/or modified sequence from HRSV(Memphis-37)__AIY60637.1__P (opt4)
  source 1..994: mol_type = other RNA
gggagactttcccattctgtagcagaatttggtgttgcctgtggtcttggtcccgcggagaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20628 - RNA, 994 nt, synthetic construct
  misc_feature 1..994: note = mRNA product Design a-5 comprising derived and/or modified sequence from HRSV(Memphis-37)__AIY60637.1__P (opt5)
  source 1..994: mol_type = other RNA
gggagactttcccattctgtagcagaatttggtgttgcctgtggtcttggtcccgcggagaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20629 - RNA, 994 nt, synthetic construct
  misc_feature 1..994: note = mRNA product Design a-5 comprising derived and/or modified sequence from HRSV(Memphis-37)__AIY60637.1__P (opt6)
  source 1..994: mol_type = other RNA
gggagactttcccattctgtagcagaatttggtgttgcctgtggtcttggtcccgcggagaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20630 - RNA, 994 nt, synthetic construct
  misc_feature 1..994: note = mRNA product Design a-5 comprising derived and/or modified sequence from HRSV(Memphis-37)__AIY60637.1__P (opt11)
  source 1..994: mol_type = other RNA
gggagactttcccattctgtagcagaatttggtgttgcctgtggtcttggtcccgcggagaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20631 - RNA, 1175 nt, synthetic construct
  misc_feature 1..1175: note = mRNA product Design b-1 comprising derived and/or modified sequence from HRSV(Memphis-37)__AIY60637.1__P (wt)
  source 1..1175: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20632 - RNA, 1175 nt, synthetic construct
  misc_feature 1..1175: note = mRNA product Design b-1 comprising derived and/or modified sequence from HRSV(Memphis-37)__AIY60637.1__P (opt1)
  source 1..1175: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20633 - RNA, 1175 nt, synthetic construct
  misc_feature 1..1175: note = mRNA product Design b-1 comprising derived and/or modified sequence from HRSV(Memphis-37)__AIY60637.1__P (opt2)
  source 1..1175: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20634 - RNA, 1175 nt, synthetic construct
  misc_feature 1..1175: note = mRNA product Design b-1 comprising derived and/or modified sequence from HRSV(Memphis-37)__AIY60637.1__P (opt3)
  source 1..1175: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20635 - RNA, 1175 nt, synthetic construct
  misc_feature 1..1175: note = mRNA product Design b-1 comprising derived and/or modified sequence from HRSV(Memphis-37)__AIY60637.1__P (opt4)
  source 1..1175: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20636 - RNA, 1175 nt, synthetic construct
  misc_feature 1..1175: note = mRNA product Design b-1 comprising derived and/or modified sequence from HRSV(Memphis-37)__AIY60637.1__P (opt5)
  source 1..1175: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20637 - RNA, 1175 nt, synthetic construct
  misc_feature 1..1175: note = mRNA product Design b-1 comprising derived and/or modified sequence from HRSV(Memphis-37)__AIY60637.1__P (opt6)
  source 1..1175: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20638 - RNA, 1175 nt, synthetic construct
  misc_feature 1..1175: note = mRNA product Design b-1 comprising derived and/or modified sequence from HRSV(Memphis-37)__AIY60637.1__P (opt11)
  source 1..1175: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20639 - RNA, 995 nt, synthetic construct
  misc_feature 1..995: note = mRNA product Design b-2 comprising derived and/or modified sequence from HRSV(Memphis-37)__AIY60637.1__P (wt)
  source 1..995: mol_type = other RNA
gggagagcctctgctggagtccggggagtggcgttggctgctagagcgaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20640 - RNA, 995 nt, synthetic construct
  misc_feature 1..995: note = mRNA product Design b-2 comprising derived and/or modified sequence from HRSV(Memphis-37)__AIY60637.1__P (opt1)
  source 1..995: mol_type = other RNA
gggagagcctctgctggagtccggggagtggcgttggctgctagagcgaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20641 - RNA, 995 nt, synthetic construct
  misc_feature 1..995: note = mRNA product Design b-2 comprising derived and/or modified sequence from HRSV(Memphis-37)__AIY60637.1__P (opt2)
  source 1..995: mol_type = other RNA
gggagagcctctgctggagtccggggagtggcgttggctgctagagcgaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20642 - RNA, 995 nt, synthetic construct
  misc_feature 1..995: note = mRNA product Design b-2 comprising derived and/or modified sequence from HRSV(Memphis-37)__AIY60637.1__P (opt3)
  source 1..995: mol_type = other RNA
gggagagcctctgctggagtccggggagtggcgttggctgctagagcgaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20643 - RNA, 995 nt, synthetic construct
  misc_feature 1..995: note = mRNA product Design b-2 comprising derived and/or modified sequence from HRSV(Memphis-37)__AIY60637.1__P (opt4)
  source 1..995: mol_type = other RNA
gggagagcctctgctggagtccggggagtggcgttggctgctagagcgaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20644 - RNA, 995 nt, synthetic construct
  misc_feature 1..995: note = mRNA product Design b-2 comprising derived and/or modified sequence from HRSV(Memphis-37)__AIY60637.1__P (opt5)
  source 1..995: mol_type = other RNA
gggagagcctctgctggagtccggggagtggcgttggctgctagagcgaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20645 - RNA, 995 nt, synthetic construct
  misc_feature 1..995: note = mRNA product Design b-2 comprising derived and/or modified sequence from HRSV(Memphis-37)__AIY60637.1__P (opt6)
  source 1..995: mol_type = other RNA
gggagagcctctgctggagtccggggagtggcgttggctgctagagcgaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20646 - RNA, 995 nt, synthetic construct
  misc_feature 1..995: note = mRNA product Design b-2 comprising derived and/or modified sequence from HRSV(Memphis-37)__AIY60637.1__P (opt11)
  source 1..995: mol_type = other RNA
gggagagcctctgctggagtccggggagtggcgttggctgctagagcgaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20647 - RNA, 1015 nt, synthetic construct
  misc_feature 1..1015: note = mRNA product Design b-3 comprising derived and/or modified sequence from HRSV(Memphis-37)__AIY60637.1__P (wt)
  source 1..1015: mol_type = other RNA
gggagagtcccgcagtcggcgtccagcggctctgcttgttcgtgtgtgtgtcgttgcaggccttattcaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20648 - RNA, 1015 nt, synthetic construct
  misc_feature 1..1015: note = mRNA product Design b-3 comprising derived and/or modified sequence from HRSV(Memphis-37)__AIY60637.1__P (opt1)
  source 1..1015: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20649 - RNA, 1015 nt, synthetic construct
  misc_feature 1..1015: note = mRNA product Design b-3 comprising derived and/or modified sequence from HRSV(Memphis-37)__AIY60637.1__P (opt2)
  source 1..1015: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20650 - RNA, 1015 nt, synthetic construct
  misc_feature 1..1015: note = mRNA product Design b-3 comprising derived and/or modified sequence from HRSV(Memphis-37)__AIY60637.1__P (opt3)
  source 1..1015: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20651 - RNA, 1015 nt, synthetic construct
  misc_feature 1..1015: note = mRNA product Design b-3 comprising derived and/or modified sequence from HRSV(Memphis-37)__AIY60637.1__P (opt4)
  source 1..1015: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20652 - RNA, 1015 nt, synthetic construct
  misc_feature 1..1015: note = mRNA product Design b-3 comprising derived and/or modified sequence from HRSV(Memphis-37)__AIY60637.1__P (opt5)
  source 1..1015: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20653 - RNA, 1015 nt, synthetic construct
  misc_feature 1..1015: note = mRNA product Design b-3 comprising derived and/or modified sequence from HRSV(Memphis-37)__AIY60637.1__P (opt6)
  source 1..1015: mol_type = other RNA
gggagagtcccgcagtcggcgtccagcggctctgcttgttcgtgtgtgtgtcgttgcaggccttattcaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20654 - RNA, 1015 nt, synthetic construct
  misc_feature 1..1015: note = mRNA product Design b-3 comprising derived and/or modified sequence from HRSV(Memphis-37)__AIY60637.1__P (opt11)
  source 1..1015: mol_type = other RNA
gggagagtcccgcagtcggcgtccagcggctctgcttgttcgtgtgtgtgtcgttgcaggccttattcaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20655 - RNA, 1066 nt, synthetic construct
  misc_feature 1..1066: note = mRNA product Design b-4 comprising derived and/or modified sequence from HRSV(Memphis-37)__AIY60637.1__P (wt)
  source 1..1066: mol_type = other RNA
gggagagtcccgcagtcggcgtccagcggctctgcttgttcgtgtgtgtgtcgttgcaggccttattcaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20656 - RNA, 1066 nt, synthetic construct
  misc_feature 1..1066: note = mRNA product Design b-4 comprising derived and/or modified sequence from HRSV(Memphis-37)__AIY60637.1__P (opt1)
  source 1..1066: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20657 - RNA, 1066 nt, synthetic construct
  misc_feature 1..1066: note = mRNA product Design b-4 comprising derived and/or modified sequence from HRSV(Memphis-37)__AIY60637.1__P (opt2)
  source 1..1066: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20658 - RNA, 1066 nt, synthetic construct
  misc_feature 1..1066: note = mRNA product Design b-4 comprising derived and/or modified sequence from HRSV(Memphis-37)__AIY60637.1__P (opt3)
  source 1..1066: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20659 - RNA, 1066 nt, synthetic construct
  misc_feature 1..1066: note = mRNA product Design b-4 comprising derived and/or modified sequence from HRSV(Memphis-37)__AIY60637.1__P (opt4)
  source 1..1066: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20660 - RNA, 1066 nt, synthetic construct
  misc_feature 1..1066: note = mRNA product Design b-4 comprising derived and/or modified sequence from HRSV(Memphis-37)__AIY60637.1__P (opt5)
  source 1..1066: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20661 - RNA, 1066 nt, synthetic construct
  misc_feature 1..1066: note = mRNA product Design b-4 comprising derived and/or modified sequence from HRSV(Memphis-37)__AIY60637.1__P (opt6)
  source 1..1066: mol_type = other RNA
gggagagtcccgcagtcggcgtccagcggctctgcttgttcgtgtgtgtgtcgttgcaggccttattcaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20662 - RNA, 1066 nt, synthetic construct
  misc_feature 1..1066: note = mRNA product Design b-4 comprising derived and/or modified sequence from HRSV(Memphis-37)__AIY60637.1__P (opt11)
  source 1..1066: mol_type = other RNA
gggagagtcccgcagtcggcgtccagcggctctgcttgttcgtgtgtgtgtcgttgcaggccttattcaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20663 - RNA, 1128 nt, synthetic construct
  misc_feature 1..1128: note = mRNA product Design b-5 comprising derived and/or modified sequence from HRSV(Memphis-37)__AIY60637.1__P (wt)
  source 1..1128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20664 - RNA, 1128 nt, synthetic construct
  misc_feature 1..1128: note = mRNA product Design b-5 comprising derived and/or modified sequence from HRSV(Memphis-37)__AIY60637.1__P (opt1)
  source 1..1128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20665 - RNA, 1128 nt, synthetic construct
  misc_feature 1..1128: note = mRNA product Design b-5 comprising derived and/or modified sequence from HRSV(Memphis-37)__AIY60637.1__P (opt2)
  source 1..1128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20666 - RNA, 1128 nt, synthetic construct
  misc_feature 1..1128: note = mRNA product Design b-5 comprising derived and/or modified sequence from HRSV(Memphis-37)__AIY60637.1__P (opt3)
  source 1..1128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20667 - RNA, 1128 nt, synthetic construct
  misc_feature 1..1128: note = mRNA product Design b-5 comprising derived and/or modified sequence from HRSV(Memphis-37)__AIY60637.1__P (opt4)
  source 1..1128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20668 - RNA, 1128 nt, synthetic construct
  misc_feature 1..1128: note = mRNA product Design b-5 comprising derived and/or modified sequence from HRSV(Memphis-37)__AIY60637.1__P (opt5)
  source 1..1128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20669 - RNA, 1128 nt, synthetic construct
  misc_feature 1..1128: note = mRNA product Design b-5 comprising derived and/or modified sequence from HRSV(Memphis-37)__AIY60637.1__P (opt6)
  source 1..1128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20670 - RNA, 1128 nt, synthetic construct
  misc_feature 1..1128: note = mRNA product Design b-5 comprising derived and/or modified sequence from HRSV(Memphis-37)__AIY60637.1__P (opt11)
  source 1..1128: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20671 - RNA, 1034 nt, synthetic construct
  misc_feature 1..1034: note = mRNA product Design c-1 comprising derived and/or modified sequence from HRSV(Memphis-37)__AIY60637.1__P (wt)
  source 1..1034: mol_type = other RNA
gggagagtccgctcagccaggttgcagaagcggcttagcgtgtgtcctaatcttctctctgcgtgtaggtaggcctgtgccgcaaacaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20672 - RNA, 1034 nt, synthetic construct
  misc_feature 1..1034: note = mRNA product Design c-1 comprising derived and/or modified sequence from HRSV(Memphis-37)__AIY60637.1__P (opt1)
  source 1..1034: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20673 - RNA, 1034 nt, synthetic construct
  misc_feature 1..1034: note = mRNA product Design c-1 comprising derived and/or modified sequence from HRSV(Memphis-37)__AIY60637.1__P (opt2)
  source 1..1034: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20674 - RNA, 1034 nt, synthetic construct
  misc_feature 1..1034: note = mRNA product Design c-1 comprising derived and/or modified sequence from HRSV(Memphis-37)__AIY60637.1__P (opt3)
  source 1..1034: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20675 - RNA, 1034 nt, synthetic construct
  misc_feature 1..1034: note = mRNA product Design c-1 comprising derived and/or modified sequence from HRSV(Memphis-37)__AIY60637.1__P (opt4)
  source 1..1034: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20676 - RNA, 1034 nt, synthetic construct
  misc_feature 1..1034: note = mRNA product Design c-1 comprising derived and/or modified sequence from HRSV(Memphis-37)__AIY60637.1__P (opt5)
  source 1..1034: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20677 - RNA, 1034 nt, synthetic construct
  misc_feature 1..1034: note = mRNA product Design c-1 comprising derived and/or modified sequence from HRSV(Memphis-37)__AIY60637.1__P (opt6)
  source 1..1034: mol_type = other RNA
gggagagtccgctcagccaggttgcagaagcggcttagcgtgtgtcctaatcttctctctgcgtgtaggtaggcctgtgccgcaaacaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20678 - RNA, 1034 nt, synthetic construct
  misc_feature 1..1034: note = mRNA product Design c-1 comprising derived and/or modified sequence from HRSV(Memphis-37)__AIY60637.1__P (opt11)
  source 1..1034: mol_type = other RNA
gggagagtccgctcagccaggttgcagaagcggcttagcgtgtgtcctaatcttctctctgcgtgtaggtaggcctgtgccgcaaacaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20679 - RNA, 1124 nt, synthetic construct
  misc_feature 1..1124: note = mRNA product Design c-2 comprising derived and/or modified sequence from HRSV(Memphis-37)__AIY60637.1__P (wt)
  source 1..1124: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20680 - RNA, 1124 nt, synthetic construct
  misc_feature 1..1124: note = mRNA product Design c-2 comprising derived and/or modified sequence from HRSV(Memphis-37)__AIY60637.1__P (opt1)
  source 1..1124: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20681 - RNA, 1124 nt, synthetic construct
  misc_feature 1..1124: note = mRNA product Design c-2 comprising derived and/or modified sequence from HRSV(Memphis-37)__AIY60637.1__P (opt2)
  source 1..1124: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20682 - RNA, 1124 nt, synthetic construct
  misc_feature 1..1124: note = mRNA product Design c-2 comprising derived and/or modified sequence from HRSV(Memphis-37)__AIY60637.1__P (opt3)
  source 1..1124: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20683 - RNA, 1124 nt, synthetic construct
  misc_feature 1..1124: note = mRNA product Design c-2 comprising derived and/or modified sequence from HRSV(Memphis-37)__AIY60637.1__P (opt4)
  source 1..1124: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20684 - RNA, 1124 nt, synthetic construct
  misc_feature 1..1124: note = mRNA product Design c-2 comprising derived and/or modified sequence from HRSV(Memphis-37)__AIY60637.1__P (opt5)
  source 1..1124: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20685 - RNA, 1124 nt, synthetic construct
  misc_feature 1..1124: note = mRNA product Design c-2 comprising derived and/or modified sequence from HRSV(Memphis-37)__AIY60637.1__P (opt6)
  source 1..1124: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20686 - RNA, 1124 nt, synthetic construct
  misc_feature 1..1124: note = mRNA product Design c-2 comprising derived and/or modified sequence from HRSV(Memphis-37)__AIY60637.1__P (opt11)
  source 1..1124: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20687 - RNA, 1101 nt, synthetic construct
  misc_feature 1..1101: note = mRNA product Design c-3 comprising derived and/or modified sequence from HRSV(Memphis-37)__AIY60637.1__P (wt)
  source 1..1101: mol_type = other RNA
gggagagtccgctcagccaggttgcagaagcggcttagcgtgtgtcctaatcttctctctgcgtgtaggtaggcctgtgccgcaaacaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20688 - RNA, 1101 nt, synthetic construct
  misc_feature 1..1101: note = mRNA product Design c-3 comprising derived and/or modified sequence from HRSV(Memphis-37)__AIY60637.1__P (opt1)
  source 1..1101: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20689 - RNA, 1101 nt, synthetic construct
  misc_feature 1..1101: note = mRNA product Design c-3 comprising derived and/or modified sequence from HRSV(Memphis-37)__AIY60637.1__P (opt2)
  source 1..1101: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20690 - RNA, 1101 nt, synthetic construct
  misc_feature 1..1101: note = mRNA product Design c-3 comprising derived and/or modified sequence from HRSV(Memphis-37)__AIY60637.1__P (opt3)
  source 1..1101: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20691 - RNA, 1101 nt, synthetic construct
  misc_feature 1..1101: note = mRNA product Design c-3 comprising derived and/or modified sequence from HRSV(Memphis-37)__AIY60637.1__P (opt4)
  source 1..1101: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20692 - RNA, 1101 nt, synthetic construct
  misc_feature 1..1101: note = mRNA product Design c-3 comprising derived and/or modified sequence from HRSV(Memphis-37)__AIY60637.1__P (opt5)
  source 1..1101: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20693 - RNA, 1101 nt, synthetic construct
  misc_feature 1..1101: note = mRNA product Design c-3 comprising derived and/or modified sequence from HRSV(Memphis-37)__AIY60637.1__P (opt6)
  source 1..1101: mol_type = other RNA
gggagagtccgctcagccaggttgcagaagcggcttagcgtgtgtcctaatcttctctctgcgtgtaggtaggcctgtgccgcaaacaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20694 - RNA, 1101 nt, synthetic construct
  misc_feature 1..1101: note = mRNA product Design c-3 comprising derived and/or modified sequence from HRSV(Memphis-37)__AIY60637.1__P (opt11)
  source 1..1101: mol_type = other RNA
gggagagtccgctcagccaggttgcagaagcggcttagcgtgtgtcctaatcttctctctgcgtgtaggtaggcctgtgccgcaaacaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20695 - RNA, 1097 nt, synthetic construct
  misc_feature 1..1097: note = mRNA product Design c-4 comprising derived and/or modified sequence from HRSV(Memphis-37)__AIY60637.1__P (wt)
  source 1..1097: mol_type = other RNA
gggagagtccgctcagccaggttgcagaagcggcttagcgtgtgtcctaatcttctctctgcgtgtaggtaggcctgtgccgcaaacaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20696 - RNA, 1097 nt, synthetic construct
  misc_feature 1..1097: note = mRNA product Design c-4 comprising derived and/or modified sequence from HRSV(Memphis-37)__AIY60637.1__P (opt1)
  source 1..1097: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20697 - RNA, 1097 nt, synthetic construct
  misc_feature 1..1097: note = mRNA product Design c-4 comprising derived and/or modified sequence from HRSV(Memphis-37)__AIY60637.1__P (opt2)
  source 1..1097: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20698 - RNA, 1097 nt, synthetic construct
  misc_feature 1..1097: note = mRNA product Design c-4 comprising derived and/or modified sequence from HRSV(Memphis-37)__AIY60637.1__P (opt3)
  source 1..1097: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20699 - RNA, 1097 nt, synthetic construct
  misc_feature 1..1097: note = mRNA product Design c-4 comprising derived and/or modified sequence from HRSV(Memphis-37)__AIY60637.1__P (opt4)
  source 1..1097: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20700 - RNA, 1097 nt, synthetic construct
  misc_feature 1..1097: note = mRNA product Design c-4 comprising derived and/or modified sequence from HRSV(Memphis-37)__AIY60637.1__P (opt5)
  source 1..1097: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20701 - RNA, 1097 nt, synthetic construct
  misc_feature 1..1097: note = mRNA product Design c-4 comprising derived and/or modified sequence from HRSV(Memphis-37)__AIY60637.1__P (opt6)
  source 1..1097: mol_type = other RNA
gggagagtccgctcagccaggttgcagaagcggcttagcgtgtgtcctaatcttctctctgcgtgtaggtaggcctgtgccgcaaacaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20702 - RNA, 1097 nt, synthetic construct
  misc_feature 1..1097: note = mRNA product Design c-4 comprising derived and/or modified sequence from HRSV(Memphis-37)__AIY60637.1__P (opt11)
  source 1..1097: mol_type = other RNA
gggagagtccgctcagccaggttgcagaagcggcttagcgtgtgtcctaatcttctctctgcgtgtaggtaggcctgtgccgcaaacaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20703 - RNA, 1015 nt, synthetic construct
  misc_feature 1..1015: note = mRNA product Design c-5 comprising derived and/or modified sequence from HRSV(Memphis-37)__AIY60637.1__P (wt)
  source 1..1015: mol_type = other RNA
gggagagcggctcggccattttgtcccagtcagtccggaggctgcggctgcagaagtaccgcctgcggagtaactgcaaagaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20704 - RNA, 1015 nt, synthetic construct
  misc_feature 1..1015: note = mRNA product Design c-5 comprising derived and/or modified sequence from HRSV(Memphis-37)__AIY60637.1__P (opt1)
  source 1..1015: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20705 - RNA, 1015 nt, synthetic construct
  misc_feature 1..1015: note = mRNA product Design c-5 comprising derived and/or modified sequence from HRSV(Memphis-37)__AIY60637.1__P (opt2)
  source 1..1015: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20706 - RNA, 1015 nt, synthetic construct
  misc_feature 1..1015: note = mRNA product Design c-5 comprising derived and/or modified sequence from HRSV(Memphis-37)__AIY60637.1__P (opt3)
  source 1..1015: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20707 - RNA, 1015 nt, synthetic construct
  misc_feature 1..1015: note = mRNA product Design c-5 comprising derived and/or modified sequence from HRSV(Memphis-37)__AIY60637.1__P (opt4)
  source 1..1015: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20708 - RNA, 1015 nt, synthetic construct
  misc_feature 1..1015: note = mRNA product Design c-5 comprising derived and/or modified sequence from HRSV(Memphis-37)__AIY60637.1__P (opt5)
  source 1..1015: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20709 - RNA, 1015 nt, synthetic construct
  misc_feature 1..1015: note = mRNA product Design c-5 comprising derived and/or modified sequence from HRSV(Memphis-37)__AIY60637.1__P (opt6)
  source 1..1015: mol_type = other RNA
gggagagcggctcggccattttgtcccagtcagtccggaggctgcggctgcagaagtaccgcctgcggagtaactgcaaagaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20710 - RNA, 1015 nt, synthetic construct
  misc_feature 1..1015: note = mRNA product Design c-5 comprising derived and/or modified sequence from HRSV(Memphis-37)__AIY60637.1__P (opt11)
  source 1..1015: mol_type = other RNA
gggagagcggctcggccattttgtcccagtcagtccggaggctgcggctgcagaagtaccgcctgcggagtaactgcaaagaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20711 - RNA, 1024 nt, synthetic construct
  misc_feature 1..1024: note = mRNA product Design d-1 comprising derived and/or modified sequence from HRSV(Memphis-37)__AIY60637.1__P (wt)
  source 1..1024: mol_type = other RNA
gggagacccgtgacccggaagttgtacggctacgcgactttccctcccacaaaccctcgcgcccttcctttcctacttgggcccggcagaaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20712 - RNA, 1024 nt, synthetic construct
  misc_feature 1..1024: note = mRNA product Design d-1 comprising derived and/or modified sequence from HRSV(Memphis-37)__AIY60637.1__P (opt1)
  source 1..1024: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20713 - RNA, 1024 nt, synthetic construct
  misc_feature 1..1024: note = mRNA product Design d-1 comprising derived and/or modified sequence from HRSV(Memphis-37)__AIY60637.1__P (opt2)
  source 1..1024: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20714 - RNA, 1024 nt, synthetic construct
  misc_feature 1..1024: note = mRNA product Design d-1 comprising derived and/or modified sequence from HRSV(Memphis-37)__AIY60637.1__P (opt3)
  source 1..1024: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20715 - RNA, 1024 nt, synthetic construct
  misc_feature 1..1024: note = mRNA product Design d-1 comprising derived and/or modified sequence from HRSV(Memphis-37)__AIY60637.1__P (opt4)
  source 1..1024: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20716 - RNA, 1024 nt, synthetic construct
  misc_feature 1..1024: note = mRNA product Design d-1 comprising derived and/or modified sequence from HRSV(Memphis-37)__AIY60637.1__P (opt5)
  source 1..1024: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20717 - RNA, 1024 nt, synthetic construct
  misc_feature 1..1024: note = mRNA product Design d-1 comprising derived and/or modified sequence from HRSV(Memphis-37)__AIY60637.1__P (opt6)
  source 1..1024: mol_type = other RNA
gggagacccgtgacccggaagttgtacggctacgcgactttccctcccacaaaccctcgcgcccttcctttcctacttgggcccggcagaaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20718 - RNA, 1024 nt, synthetic construct
  misc_feature 1..1024: note = mRNA product Design d-1 comprising derived and/or modified sequence from HRSV(Memphis-37)__AIY60637.1__P (opt11)
  source 1..1024: mol_type = other RNA
gggagacccgtgacccggaagttgtacggctacgcgactttccctcccacaaaccctcgcgcccttcctttcctacttgggcccggcagaaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20719 - RNA, 1079 nt, synthetic construct
  misc_feature 1..1079: note = mRNA product Design d-2 comprising derived and/or modified sequence from HRSV(Memphis-37)__AIY60637.1__P (wt)
  source 1..1079: mol_type = other RNA
gggagagcggctcggccattttgtcccagtcagtccggaggctgcggctgcagaagtaccgcctgcggagtaactgcaaagaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20720 - RNA, 1079 nt, synthetic construct
  misc_feature 1..1079: note = mRNA product Design d-2 comprising derived and/or modified sequence from HRSV(Memphis-37)__AIY60637.1__P (opt1)
  source 1..1079: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20721 - RNA, 1079 nt, synthetic construct
  misc_feature 1..1079: note = mRNA product Design d-2 comprising derived and/or modified sequence from HRSV(Memphis-37)__AIY60637.1__P (opt2)
  source 1..1079: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20722 - RNA, 1079 nt, synthetic construct
  misc_feature 1..1079: note = mRNA product Design d-2 comprising derived and/or modified sequence from HRSV(Memphis-37)__AIY60637.1__P (opt3)
  source 1..1079: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20723 - RNA, 1079 nt, synthetic construct
  misc_feature 1..1079: note = mRNA product Design d-2 comprising derived and/or modified sequence from HRSV(Memphis-37)__AIY60637.1__P (opt4)
  source 1..1079: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20724 - RNA, 1079 nt, synthetic construct
  misc_feature 1..1079: note = mRNA product Design d-2 comprising derived and/or modified sequence from HRSV(Memphis-37)__AIY60637.1__P (opt5)
  source 1..1079: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20725 - RNA, 1079 nt, synthetic construct
  misc_feature 1..1079: note = mRNA product Design d-2 comprising derived and/or modified sequence from HRSV(Memphis-37)__AIY60637.1__P (opt6)
  source 1..1079: mol_type = other RNA
gggagagcggctcggccattttgtcccagtcagtccggaggctgcggctgcagaagtaccgcctgcggagtaactgcaaagaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20726 - RNA, 1079 nt, synthetic construct
  misc_feature 1..1079: note = mRNA product Design d-2 comprising derived and/or modified sequence from HRSV(Memphis-37)__AIY60637.1__P (opt11)
  source 1..1079: mol_type = other RNA
gggagagcggctcggccattttgtcccagtcagtccggaggctgcggctgcagaagtaccgcctgcggagtaactgcaaagaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20727 - RNA, 1395 nt, synthetic construct
  misc_feature 1..1395: note = mRNA product Design d-3 comprising derived and/or modified sequence from HRSV(Memphis-37)__AIY60637.1__P (wt)
  source 1..1395: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20728 - RNA, 1395 nt, synthetic construct
  misc_feature 1..1395: note = mRNA product Design d-3 comprising derived and/or modified sequence from HRSV(Memphis-37)__AIY60637.1__P (opt1)
  source 1..1395: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20729 - RNA, 1395 nt, synthetic construct
  misc_feature 1..1395: note = mRNA product Design d-3 comprising derived and/or modified sequence from HRSV(Memphis-37)__AIY60637.1__P (opt2)
  source 1..1395: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20730 - RNA, 1395 nt, synthetic construct
  misc_feature 1..1395: note = mRNA product Design d-3 comprising derived and/or modified sequence from HRSV(Memphis-37)__AIY60637.1__P (opt3)
  source 1..1395: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20731 - RNA, 1395 nt, synthetic construct
  misc_feature 1..1395: note = mRNA product Design d-3 comprising derived and/or modified sequence from HRSV(Memphis-37)__AIY60637.1__P (opt4)
  source 1..1395: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20732 - RNA, 1395 nt, synthetic construct
  misc_feature 1..1395: note = mRNA product Design d-3 comprising derived and/or modified sequence from HRSV(Memphis-37)__AIY60637.1__P (opt5)
  source 1..1395: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20733 - RNA, 1395 nt, synthetic construct
  misc_feature 1..1395: note = mRNA product Design d-3 comprising derived and/or modified sequence from HRSV(Memphis-37)__AIY60637.1__P (opt6)
  source 1..1395: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20734 - RNA, 1395 nt, synthetic construct
  misc_feature 1..1395: note = mRNA product Design d-3 comprising derived and/or modified sequence from HRSV(Memphis-37)__AIY60637.1__P (opt11)
  source 1..1395: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20735 - RNA, 1078 nt, synthetic construct
  misc_feature 1..1078: note = mRNA product Design d-4 comprising derived and/or modified sequence from HRSV(Memphis-37)__AIY60637.1__P (wt)
  source 1..1078: mol_type = other RNA
gggagagtcccgcagtcggcgtccagcggctctgcttgttcgtgtgtgtgtcgttgcaggccttattcaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20736 - RNA, 1078 nt, synthetic construct
  misc_feature 1..1078: note = mRNA product Design d-4 comprising derived and/or modified sequence from HRSV(Memphis-37)__AIY60637.1__P (opt1)
  source 1..1078: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20737 - RNA, 1078 nt, synthetic construct
  misc_feature 1..1078: note = mRNA product Design d-4 comprising derived and/or modified sequence from HRSV(Memphis-37)__AIY60637.1__P (opt2)
  source 1..1078: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20738 - RNA, 1078 nt, synthetic construct
  misc_feature 1..1078: note = mRNA product Design d-4 comprising derived and/or modified sequence from HRSV(Memphis-37)__AIY60637.1__P (opt3)
  source 1..1078: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20739 - RNA, 1078 nt, synthetic construct
  misc_feature 1..1078: note = mRNA product Design d-4 comprising derived and/or modified sequence from HRSV(Memphis-37)__AIY60637.1__P (opt4)
  source 1..1078: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20740 - RNA, 1078 nt, synthetic construct
  misc_feature 1..1078: note = mRNA product Design d-4 comprising derived and/or modified sequence from HRSV(Memphis-37)__AIY60637.1__P (opt5)
  source 1..1078: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20741 - RNA, 1078 nt, synthetic construct
  misc_feature 1..1078: note = mRNA product Design d-4 comprising derived and/or modified sequence from HRSV(Memphis-37)__AIY60637.1__P (opt6)
  source 1..1078: mol_type = other RNA
gggagagtcccgcagtcggcgtccagcggctctgcttgttcgtgtgtgtgtcgttgcaggccttattcaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20742 - RNA, 1078 nt, synthetic construct
  misc_feature 1..1078: note = mRNA product Design d-4 comprising derived and/or modified sequence from HRSV(Memphis-37)__AIY60637.1__P (opt11)
  source 1..1078: mol_type = other RNA
gggagagtcccgcagtcggcgtccagcggctctgcttgttcgtgtgtgtgtcgttgcaggccttattcaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20743 - RNA, 1175 nt, synthetic construct
  misc_feature 1..1175: note = mRNA product Design d-5 comprising derived and/or modified sequence from HRSV(Memphis-37)__AIY60637.1__P (wt)
  source 1..1175: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20744 - RNA, 1175 nt, synthetic construct
  misc_feature 1..1175: note = mRNA product Design d-5 comprising derived and/or modified sequence from HRSV(Memphis-37)__AIY60637.1__P (opt1)
  source 1..1175: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20745 - RNA, 1175 nt, synthetic construct
  misc_feature 1..1175: note = mRNA product Design d-5 comprising derived and/or modified sequence from HRSV(Memphis-37)__AIY60637.1__P (opt2)
  source 1..1175: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20746 - RNA, 1175 nt, synthetic construct
  misc_feature 1..1175: note = mRNA product Design d-5 comprising derived and/or modified sequence from HRSV(Memphis-37)__AIY60637.1__P (opt3)
  source 1..1175: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20747 - RNA, 1175 nt, synthetic construct
  misc_feature 1..1175: note = mRNA product Design d-5 comprising derived and/or modified sequence from HRSV(Memphis-37)__AIY60637.1__P (opt4)
  source 1..1175: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20748 - RNA, 1175 nt, synthetic construct
  misc_feature 1..1175: note = mRNA product Design d-5 comprising derived and/or modified sequence from HRSV(Memphis-37)__AIY60637.1__P (opt5)
  source 1..1175: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20749 - RNA, 1175 nt, synthetic construct
  misc_feature 1..1175: note = mRNA product Design d-5 comprising derived and/or modified sequence from HRSV(Memphis-37)__AIY60637.1__P (opt6)
  source 1..1175: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20750 - RNA, 1175 nt, synthetic construct
  misc_feature 1..1175: note = mRNA product Design d-5 comprising derived and/or modified sequence from HRSV(Memphis-37)__AIY60637.1__P (opt11)
  source 1..1175: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20751 - RNA, 1055 nt, synthetic construct
  misc_feature 1..1055: note = mRNA product Design e-1 comprising derived and/or modified sequence from HRSV(Memphis-37)__AIY60637.1__P (wt)
  source 1..1055: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20752 - RNA, 1055 nt, synthetic construct
  misc_feature 1..1055: note = mRNA product Design e-1 comprising derived and/or modified sequence from HRSV(Memphis-37)__AIY60637.1__P (opt1)
  source 1..1055: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20753 - RNA, 1055 nt, synthetic construct
  misc_feature 1..1055: note = mRNA product Design e-1 comprising derived and/or modified sequence from HRSV(Memphis-37)__AIY60637.1__P (opt2)
  source 1..1055: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20754 - RNA, 1055 nt, synthetic construct
  misc_feature 1..1055: note = mRNA product Design e-1 comprising derived and/or modified sequence from HRSV(Memphis-37)__AIY60637.1__P (opt3)
  source 1..1055: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20755 - RNA, 1055 nt, synthetic construct
  misc_feature 1..1055: note = mRNA product Design e-1 comprising derived and/or modified sequence from HRSV(Memphis-37)__AIY60637.1__P (opt4)
  source 1..1055: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20756 - RNA, 1055 nt, synthetic construct
  misc_feature 1..1055: note = mRNA product Design e-1 comprising derived and/or modified sequence from HRSV(Memphis-37)__AIY60637.1__P (opt5)
  source 1..1055: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20757 - RNA, 1055 nt, synthetic construct
  misc_feature 1..1055: note = mRNA product Design e-1 comprising derived and/or modified sequence from HRSV(Memphis-37)__AIY60637.1__P (opt6)
  source 1..1055: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20758 - RNA, 1055 nt, synthetic construct
  misc_feature 1..1055: note = mRNA product Design e-1 comprising derived and/or modified sequence from HRSV(Memphis-37)__AIY60637.1__P (opt11)
  source 1..1055: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20759 - RNA, 1037 nt, synthetic construct
  misc_feature 1..1037: note = mRNA product Design e-2 comprising derived and/or modified sequence from HRSV(Memphis-37)__AIY60637.1__P (wt)
  source 1..1037: mol_type = other RNA
gggagacccgtgacccggaagttgtacggctacgcgactttccctcccacaaaccctcgcgcccttcctttcctacttgggcccggcagaaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20760 - RNA, 1037 nt, synthetic construct
  misc_feature 1..1037: note = mRNA product Design e-2 comprising derived and/or modified sequence from HRSV(Memphis-37)__AIY60637.1__P (opt1)
  source 1..1037: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20761 - RNA, 1037 nt, synthetic construct
  misc_feature 1..1037: note = mRNA product Design e-2 comprising derived and/or modified sequence from HRSV(Memphis-37)__AIY60637.1__P (opt2)
  source 1..1037: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20762 - RNA, 1037 nt, synthetic construct
  misc_feature 1..1037: note = mRNA product Design e-2 comprising derived and/or modified sequence from HRSV(Memphis-37)__AIY60637.1__P (opt3)
  source 1..1037: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20763 - RNA, 1037 nt, synthetic construct
  misc_feature 1..1037: note = mRNA product Design e-2 comprising derived and/or modified sequence from HRSV(Memphis-37)__AIY60637.1__P (opt4)
  source 1..1037: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20764 - RNA, 1037 nt, synthetic construct
  misc_feature 1..1037: note = mRNA product Design e-2 comprising derived and/or modified sequence from HRSV(Memphis-37)__AIY60637.1__P (opt5)
  source 1..1037: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20765 - RNA, 1037 nt, synthetic construct
  misc_feature 1..1037: note = mRNA product Design e-2 comprising derived and/or modified sequence from HRSV(Memphis-37)__AIY60637.1__P (opt6)
  source 1..1037: mol_type = other RNA
gggagacccgtgacccggaagttgtacggctacgcgactttccctcccacaaaccctcgcgcccttcctttcctacttgggcccggcagaaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20766 - RNA, 1037 nt, synthetic construct
  misc_feature 1..1037: note = mRNA product Design e-2 comprising derived and/or modified sequence from HRSV(Memphis-37)__AIY60637.1__P (opt11)
  source 1..1037: mol_type = other RNA
gggagacccgtgacccggaagttgtacggctacgcgactttccctcccacaaaccctcgcgcccttcctttcctacttgggcccggcagaaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20767 - RNA, 1007 nt, synthetic construct
  misc_feature 1..1007: note = mRNA product Design e-3 comprising derived and/or modified sequence from HRSV(Memphis-37)__AIY60637.1__P (wt)
  source 1..1007: mol_type = other RNA
gggagactttcccattctgtagcagaatttggtgttgcctgtggtcttggtcccgcggagaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20768 - RNA, 1007 nt, synthetic construct
  misc_feature 1..1007: note = mRNA product Design e-3 comprising derived and/or modified sequence from HRSV(Memphis-37)__AIY60637.1__P (opt1)
  source 1..1007: mol_type = other RNA
gggagactttcccattctgtagcagaatttggtgttgcctgtggtcttggtcccgcggagaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20769 - RNA, 1007 nt, synthetic construct
  misc_feature 1..1007: note = mRNA product Design e-3 comprising derived and/or modified sequence from HRSV(Memphis-37)__AIY60637.1__P (opt2)
  source 1..1007: mol_type = other RNA
gggagactttcccattctgtagcagaatttggtgttgcctgtggtcttggtcccgcggagaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20770 - RNA, 1007 nt, synthetic construct
  misc_feature 1..1007: note = mRNA product Design e-3 comprising derived and/or modified sequence from HRSV(Memphis-37)__AIY60637.1__P (opt3)
  source 1..1007: mol_type = other RNA
gggagactttcccattctgtagcagaatttggtgttgcctgtggtcttggtcccgcggagaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20771 - RNA, 1007 nt, synthetic construct
  misc_feature 1..1007: note = mRNA product Design e-3 comprising derived and/or modified sequence from HRSV(Memphis-37)__AIY60637.1__P (opt4)
  source 1..1007: mol_type = other RNA
gggagactttcccattctgtagcagaatttggtgttgcctgtggtcttggtcccgcggagaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20772 - RNA, 1007 nt, synthetic construct
  misc_feature 1..1007: note = mRNA product Design e-3 comprising derived and/or modified sequence from HRSV(Memphis-37)__AIY60637.1__P (opt5)
  source 1..1007: mol_type = other RNA
gggagactttcccattctgtagcagaatttggtgttgcctgtggtcttggtcccgcggagaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20773 - RNA, 1007 nt, synthetic construct
  misc_feature 1..1007: note = mRNA product Design e-3 comprising derived and/or modified sequence from HRSV(Memphis-37)__AIY60637.1__P (opt6)
  source 1..1007: mol_type = other RNA
gggagactttcccattctgtagcagaatttggtgttgcctgtggtcttggtcccgcggagaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20774 - RNA, 1007 nt, synthetic construct
  misc_feature 1..1007: note = mRNA product Design e-3 comprising derived and/or modified sequence from HRSV(Memphis-37)__AIY60637.1__P (opt11)
  source 1..1007: mol_type = other RNA
gggagactttcccattctgtagcagaatttggtgttgcctgtggtcttggtcccgcggagaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20775 - RNA, 1061 nt, synthetic construct
  misc_feature 1..1061: note = mRNA product Design e-4 comprising derived and/or modified sequence from HRSV(Memphis-37)__AIY60637.1__P (wt)
  source 1..1061: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20776 - RNA, 1061 nt, synthetic construct
  misc_feature 1..1061: note = mRNA product Design e-4 comprising derived and/or modified sequence from HRSV(Memphis-37)__AIY60637.1__P (opt1)
  source 1..1061: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20777 - RNA, 1061 nt, synthetic construct
  misc_feature 1..1061: note = mRNA product Design e-4 comprising derived and/or modified sequence from HRSV(Memphis-37)__AIY60637.1__P (opt2)
  source 1..1061: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20778 - RNA, 1061 nt, synthetic construct
  misc_feature 1..1061: note = mRNA product Design e-4 comprising derived and/or modified sequence from HRSV(Memphis-37)__AIY60637.1__P (opt3)
  source 1..1061: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20779 - RNA, 1061 nt, synthetic construct
  misc_feature 1..1061: note = mRNA product Design e-4 comprising derived and/or modified sequence from HRSV(Memphis-37)__AIY60637.1__P (opt4)
  source 1..1061: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20780 - RNA, 1061 nt, synthetic construct
  misc_feature 1..1061: note = mRNA product Design e-4 comprising derived and/or modified sequence from HRSV(Memphis-37)__AIY60637.1__P (opt5)
  source 1..1061: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20781 - RNA, 1061 nt, synthetic construct
  misc_feature 1..1061: note = mRNA product Design e-4 comprising derived and/or modified sequence from HRSV(Memphis-37)__AIY60637.1__P (opt6)
  source 1..1061: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20782 - RNA, 1061 nt, synthetic construct
  misc_feature 1..1061: note = mRNA product Design e-4 comprising derived and/or modified sequence from HRSV(Memphis-37)__AIY60637.1__P (opt11)
  source 1..1061: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20783 - RNA, 1028 nt, synthetic construct
  misc_feature 1..1028: note = mRNA product Design e-5 comprising derived and/or modified sequence from HRSV(Memphis-37)__AIY60637.1__P (wt)
  source 1..1028: mol_type = other RNA
gggagagcggctcggccattttgtcccagtcagtccggaggctgcggctgcagaagtaccgcctgcggagtaactgcaaagaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20784 - RNA, 1028 nt, synthetic construct
  misc_feature 1..1028: note = mRNA product Design e-5 comprising derived and/or modified sequence from HRSV(Memphis-37)__AIY60637.1__P (opt1)
  source 1..1028: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20785 - RNA, 1028 nt, synthetic construct
  misc_feature 1..1028: note = mRNA product Design e-5 comprising derived and/or modified sequence from HRSV(Memphis-37)__AIY60637.1__P (opt2)
  source 1..1028: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20786 - RNA, 1028 nt, synthetic construct
  misc_feature 1..1028: note = mRNA product Design e-5 comprising derived and/or modified sequence from HRSV(Memphis-37)__AIY60637.1__P (opt3)
  source 1..1028: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20787 - RNA, 1028 nt, synthetic construct
  misc_feature 1..1028: note = mRNA product Design e-5 comprising derived and/or modified sequence from HRSV(Memphis-37)__AIY60637.1__P (opt4)
  source 1..1028: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20788 - RNA, 1028 nt, synthetic construct
  misc_feature 1..1028: note = mRNA product Design e-5 comprising derived and/or modified sequence from HRSV(Memphis-37)__AIY60637.1__P (opt5)
  source 1..1028: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20789 - RNA, 1028 nt, synthetic construct
  misc_feature 1..1028: note = mRNA product Design e-5 comprising derived and/or modified sequence from HRSV(Memphis-37)__AIY60637.1__P (opt6)
  source 1..1028: mol_type = other RNA
gggagagcggctcggccattttgtcccagtcagtccggaggctgcggctgcagaagtaccgcctgcggagtaactgcaaagaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20790 - RNA, 1028 nt, synthetic construct
  misc_feature 1..1028: note = mRNA product Design e-5 comprising derived and/or modified sequence from HRSV(Memphis-37)__AIY60637.1__P (opt11)
  source 1..1028: mol_type = other RNA
gggagagcggctcggccattttgtcccagtcagtccggaggctgcggctgcagaagtaccgcctgcggagtaactgcaaagaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20791 - RNA, 1095 nt, synthetic construct
  misc_feature 1..1095: note = mRNA product Design e-6 comprising derived and/or modified sequence from HRSV(Memphis-37)__AIY60637.1__P (wt)
  source 1..1095: mol_type = other RNA
gggagagcggctcggccattttgtcccagtcagtccggaggctgcggctgcagaagtaccgcctgcggagtaactgcaaagaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20792 - RNA, 1095 nt, synthetic construct
  misc_feature 1..1095: note = mRNA product Design e-6 comprising derived and/or modified sequence from HRSV(Memphis-37)__AIY60637.1__P (opt1)
  source 1..1095: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20793 - RNA, 1095 nt, synthetic construct
  misc_feature 1..1095: note = mRNA product Design e-6 comprising derived and/or modified sequence from HRSV(Memphis-37)__AIY60637.1__P (opt2)
  source 1..1095: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20794 - RNA, 1095 nt, synthetic construct
  misc_feature 1..1095: note = mRNA product Design e-6 comprising derived and/or modified sequence from HRSV(Memphis-37)__AIY60637.1__P (opt3)
  source 1..1095: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20795 - RNA, 1095 nt, synthetic construct
  misc_feature 1..1095: note = mRNA product Design e-6 comprising derived and/or modified sequence from HRSV(Memphis-37)__AIY60637.1__P (opt4)
  source 1..1095: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20796 - RNA, 1095 nt, synthetic construct
  misc_feature 1..1095: note = mRNA product Design e-6 comprising derived and/or modified sequence from HRSV(Memphis-37)__AIY60637.1__P (opt5)
  source 1..1095: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20797 - RNA, 1095 nt, synthetic construct
  misc_feature 1..1095: note = mRNA product Design e-6 comprising derived and/or modified sequence from HRSV(Memphis-37)__AIY60637.1__P (opt6)
  source 1..1095: mol_type = other RNA
gggagagcggctcggccattttgtcccagtcagtccggaggctgcggctgcagaagtaccgcctgcggagtaactgcaaagaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20798 - RNA, 1095 nt, synthetic construct
  misc_feature 1..1095: note = mRNA product Design e-6 comprising derived and/or modified sequence from HRSV(Memphis-37)__AIY60637.1__P (opt11)
  source 1..1095: mol_type = other RNA
gggagagcggctcggccattttgtcccagtcagtccggaggctgcggctgcagaagtaccgcctgcggagtaactgcaaagaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20799 - RNA, 1311 nt, synthetic construct
  misc_feature 1..1311: note = mRNA product Design f-1 comprising derived and/or modified sequence from HRSV(Memphis-37)__AIY60637.1__P (wt)
  source 1..1311: mol_type = other RNA
gggagagcggctcggccattttgtcccagtcagtccggaggctgcggctgcagaagtaccgcctgcggagtaactgcaaagaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20800 - RNA, 1311 nt, synthetic construct
  misc_feature 1..1311: note = mRNA product Design f-1 comprising derived and/or modified sequence from HRSV(Memphis-37)__AIY60637.1__P (opt1)
  source 1..1311: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20801 - RNA, 1311 nt, synthetic construct
  misc_feature 1..1311: note = mRNA product Design f-1 comprising derived and/or modified sequence from HRSV(Memphis-37)__AIY60637.1__P (opt2)
  source 1..1311: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20802 - RNA, 1311 nt, synthetic construct
  misc_feature 1..1311: note = mRNA product Design f-1 comprising derived and/or modified sequence from HRSV(Memphis-37)__AIY60637.1__P (opt3)
  source 1..1311: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20803 - RNA, 1311 nt, synthetic construct
  misc_feature 1..1311: note = mRNA product Design f-1 comprising derived and/or modified sequence from HRSV(Memphis-37)__AIY60637.1__P (opt4)
  source 1..1311: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20804 - RNA, 1311 nt, synthetic construct
  misc_feature 1..1311: note = mRNA product Design f-1 comprising derived and/or modified sequence from HRSV(Memphis-37)__AIY60637.1__P (opt5)
  source 1..1311: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20805 - RNA, 1311 nt, synthetic construct
  misc_feature 1..1311: note = mRNA product Design f-1 comprising derived and/or modified sequence from HRSV(Memphis-37)__AIY60637.1__P (opt6)
  source 1..1311: mol_type = other RNA
gggagagcggctcggccattttgtcccagtcagtccggaggctgcggctgcagaagtaccgcctgcggagtaactgcaaagaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20806 - RNA, 1311 nt, synthetic construct
  misc_feature 1..1311: note = mRNA product Design f-1 comprising derived and/or modified sequence from HRSV(Memphis-37)__AIY60637.1__P (opt11)
  source 1..1311: mol_type = other RNA
gggagagcggctcggccattttgtcccagtcagtccggaggctgcggctgcagaagtaccgcctgcggagtaactgcaaagaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20807 - RNA, 1091 nt, synthetic construct
  misc_feature 1..1091: note = mRNA product Design f-2 comprising derived and/or modified sequence from HRSV(Memphis-37)__AIY60637.1__P (wt)
  source 1..1091: mol_type = other RNA
gggagagcggctcggccattttgtcccagtcagtccggaggctgcggctgcagaagtaccgcctgcggagtaactgcaaagaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20808 - RNA, 1091 nt, synthetic construct
  misc_feature 1..1091: note = mRNA product Design f-2 comprising derived and/or modified sequence from HRSV(Memphis-37)__AIY60637.1__P (opt1)
  source 1..1091: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20809 - RNA, 1091 nt, synthetic construct
  misc_feature 1..1091: note = mRNA product Design f-2 comprising derived and/or modified sequence from HRSV(Memphis-37)__AIY60637.1__P (opt2)
  source 1..1091: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20810 - RNA, 1091 nt, synthetic construct
  misc_feature 1..1091: note = mRNA product Design f-2 comprising derived and/or modified sequence from HRSV(Memphis-37)__AIY60637.1__P (opt3)
  source 1..1091: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20811 - RNA, 1091 nt, synthetic construct
  misc_feature 1..1091: note = mRNA product Design f-2 comprising derived and/or modified sequence from HRSV(Memphis-37)__AIY60637.1__P (opt4)
  source 1..1091: mol_type = other RNA
gggagagcggctcggccattttgtcccagtcagtccggaggctgcggctgcagaagtaccgcctgcggagtaactgcaaagaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20812 - RNA, 1091 nt, synthetic construct
  misc_feature 1..1091: note = mRNA product Design f-2 comprising derived and/or modified sequence from HRSV(Memphis-37)__AIY60637.1__P (opt5)
  source 1..1091: mol_type = other RNA
gggagagcggctcggccattttgtcccagtcagtccggaggctgcggctgcagaagtaccgcctgcggagtaactgcaaagaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20813 - RNA, 1091 nt, synthetic construct
  misc_feature 1..1091: note = mRNA product Design f-2 comprising derived and/or modified sequence from HRSV(Memphis-37)__AIY60637.1__P (opt6)
  source 1..1091: mol_type = other RNA
gggagagcggctcggccattttgtcccagtcagtccggaggctgcggctgcagaagtaccgcctgcggagtaactgcaaagaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20814 - RNA, 1091 nt, synthetic construct
  misc_feature 1..1091: note = mRNA product Design f-2 comprising derived and/or modified sequence from HRSV(Memphis-37)__AIY60637.1__P (opt11)
  source 1..1091: mol_type = other RNA
gggagagcggctcggccattttgtcccagtcagtccggaggctgcggctgcagaagtaccgcctgcggagtaactgcaaagaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20815 - RNA, 1082 nt, synthetic construct
  misc_feature 1..1082: note = mRNA product Design f-3 comprising derived and/or modified sequence from HRSV(Memphis-37)__AIY60637.1__P (wt)
  source 1..1082: mol_type = other RNA
gggagagtcccgcagtcggcgtccagcggctctgcttgttcgtgtgtgtgtcgttgcaggccttattcaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20816 - RNA, 1082 nt, synthetic construct
  misc_feature 1..1082: note = mRNA product Design f-3 comprising derived and/or modified sequence from HRSV(Memphis-37)__AIY60637.1__P (opt1)
  source 1..1082: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20817 - RNA, 1082 nt, synthetic construct
  misc_feature 1..1082: note = mRNA product Design f-3 comprising derived and/or modified sequence from HRSV(Memphis-37)__AIY60637.1__P (opt2)
  source 1..1082: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20818 - RNA, 1082 nt, synthetic construct
  misc_feature 1..1082: note = mRNA product Design f-3 comprising derived and/or modified sequence from HRSV(Memphis-37)__AIY60637.1__P (opt3)
  source 1..1082: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20819 - RNA, 1082 nt, synthetic construct
  misc_feature 1..1082: note = mRNA product Design f-3 comprising derived and/or modified sequence from HRSV(Memphis-37)__AIY60637.1__P (opt4)
  source 1..1082: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20820 - RNA, 1082 nt, synthetic construct
  misc_feature 1..1082: note = mRNA product Design f-3 comprising derived and/or modified sequence from HRSV(Memphis-37)__AIY60637.1__P (opt5)
  source 1..1082: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20821 - RNA, 1082 nt, synthetic construct
  misc_feature 1..1082: note = mRNA product Design f-3 comprising derived and/or modified sequence from HRSV(Memphis-37)__AIY60637.1__P (opt6)
  source 1..1082: mol_type = other RNA
gggagagtcccgcagtcggcgtccagcggctctgcttgttcgtgtgtgtgtcgttgcaggccttattcaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20822 - RNA, 1082 nt, synthetic construct
  misc_feature 1..1082: note = mRNA product Design f-3 comprising derived and/or modified sequence from HRSV(Memphis-37)__AIY60637.1__P (opt11)
  source 1..1082: mol_type = other RNA
gggagagtcccgcagtcggcgtccagcggctctgcttgttcgtgtgtgtgtcgttgcaggccttattcaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20823 - RNA, 1298 nt, synthetic construct
  misc_feature 1..1298: note = mRNA product Design f-4 comprising derived and/or modified sequence from HRSV(Memphis-37)__AIY60637.1__P (wt)
  source 1..1298: mol_type = other RNA
gggagagtcccgcagtcggcgtccagcggctctgcttgttcgtgtgtgtgtcgttgcaggccttattcaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20824 - RNA, 1298 nt, synthetic construct
  misc_feature 1..1298: note = mRNA product Design f-4 comprising derived and/or modified sequence from HRSV(Memphis-37)__AIY60637.1__P (opt1)
  source 1..1298: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20825 - RNA, 1298 nt, synthetic construct
  misc_feature 1..1298: note = mRNA product Design f-4 comprising derived and/or modified sequence from HRSV(Memphis-37)__AIY60637.1__P (opt2)
  source 1..1298: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20826 - RNA, 1298 nt, synthetic construct
  misc_feature 1..1298: note = mRNA product Design f-4 comprising derived and/or modified sequence from HRSV(Memphis-37)__AIY60637.1__P (opt3)
  source 1..1298: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20827 - RNA, 1298 nt, synthetic construct
  misc_feature 1..1298: note = mRNA product Design f-4 comprising derived and/or modified sequence from HRSV(Memphis-37)__AIY60637.1__P (opt4)
  source 1..1298: mol_type = other RNA
gggagagtcccgcagtcggcgtccagcggctctgcttgttcgtgtgtgtgtcgttgcaggccttattcaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20828 - RNA, 1298 nt, synthetic construct
  misc_feature 1..1298: note = mRNA product Design f-4 comprising derived and/or modified sequence from HRSV(Memphis-37)__AIY60637.1__P (opt5)
  source 1..1298: mol_type = other RNA
gggagagtcccgcagtcggcgtccagcggctctgcttgttcgtgtgtgtgtcgttgcaggccttattcaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20829 - RNA, 1298 nt, synthetic construct
  misc_feature 1..1298: note = mRNA product Design f-4 comprising derived and/or modified sequence from HRSV(Memphis-37)__AIY60637.1__P (opt6)
  source 1..1298: mol_type = other RNA
gggagagtcccgcagtcggcgtccagcggctctgcttgttcgtgtgtgtgtcgttgcaggccttattcaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20830 - RNA, 1298 nt, synthetic construct
  misc_feature 1..1298: note = mRNA product Design f-4 comprising derived and/or modified sequence from HRSV(Memphis-37)__AIY60637.1__P (opt11)
  source 1..1298: mol_type = other RNA
gggagagtcccgcagtcggcgtccagcggctctgcttgttcgtgtgtgtgtcgttgcaggccttattcaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20831 - RNA, 1074 nt, synthetic construct
  misc_feature 1..1074: note = mRNA product Design f-5 comprising derived and/or modified sequence from HRSV(Memphis-37)__AIY60637.1__P (wt)
  source 1..1074: mol_type = other RNA
gggagactttcccattctgtagcagaatttggtgttgcctgtggtcttggtcccgcggagaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20832 - RNA, 1074 nt, synthetic construct
  misc_feature 1..1074: note = mRNA product Design f-5 comprising derived and/or modified sequence from HRSV(Memphis-37)__AIY60637.1__P (opt1)
  source 1..1074: mol_type = other RNA
gggagactttcccattctgtagcagaatttggtgttgcctgtggtcttggtcccgcggagaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20833 - RNA, 1074 nt, synthetic construct
  misc_feature 1..1074: note = mRNA product Design f-5 comprising derived and/or modified sequence from HRSV(Memphis-37)__AIY60637.1__P (opt2)
  source 1..1074: mol_type = other RNA
gggagactttcccattctgtagcagaatttggtgttgcctgtggtcttggtcccgcggagaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20834 - RNA, 1074 nt, synthetic construct
  misc_feature 1..1074: note = mRNA product Design f-5 comprising derived and/or modified sequence from HRSV(Memphis-37)__AIY60637.1__P (opt3)
  source 1..1074: mol_type = other RNA
gggagactttcccattctgtagcagaatttggtgttgcctgtggtcttggtcccgcggagaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20835 - RNA, 1074 nt, synthetic construct
  misc_feature 1..1074: note = mRNA product Design f-5 comprising derived and/or modified sequence from HRSV(Memphis-37)__AIY60637.1__P (opt4)
  source 1..1074: mol_type = other RNA
gggagactttcccattctgtagcagaatttggtgttgcctgtggtcttggtcccgcggagaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20836 - RNA, 1074 nt, synthetic construct
  misc_feature 1..1074: note = mRNA product Design f-5 comprising derived and/or modified sequence from HRSV(Memphis-37)__AIY60637.1__P (opt5)
  source 1..1074: mol_type = other RNA
gggagactttcccattctgtagcagaatttggtgttgcctgtggtcttggtcccgcggagaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20837 - RNA, 1074 nt, synthetic construct
  misc_feature 1..1074: note = mRNA product Design f-5 comprising derived and/or modified sequence from HRSV(Memphis-37)__AIY60637.1__P (opt6)
  source 1..1074: mol_type = other RNA
gggagactttcccattctgtagcagaatttggtgttgcctgtggtcttggtcccgcggagaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20838 - RNA, 1074 nt, synthetic construct
  misc_feature 1..1074: note = mRNA product Design f-5 comprising derived and/or modified sequence from HRSV(Memphis-37)__AIY60637.1__P (opt11)
  source 1..1074: mol_type = other RNA
gggagactttcccattctgtagcagaatttggtgttgcctgtggtcttggtcccgcggagaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20839 - RNA, 1070 nt, synthetic construct
  misc_feature 1..1070: note = mRNA product Design g-1 comprising derived and/or modified sequence from HRSV(Memphis-37)__AIY60637.1__P (wt)
  source 1..1070: mol_type = other RNA
gggagactttcccattctgtagcagaatttggtgttgcctgtggtcttggtcccgcggagaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20840 - RNA, 1070 nt, synthetic construct
  misc_feature 1..1070: note = mRNA product Design g-1 comprising derived and/or modified sequence from HRSV(Memphis-37)__AIY60637.1__P (opt1)
  source 1..1070: mol_type = other RNA
gggagactttcccattctgtagcagaatttggtgttgcctgtggtcttggtcccgcggagaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20841 - RNA, 1070 nt, synthetic construct
  misc_feature 1..1070: note = mRNA product Design g-1 comprising derived and/or modified sequence from HRSV(Memphis-37)__AIY60637.1__P (opt2)
  source 1..1070: mol_type = other RNA
gggagactttcccattctgtagcagaatttggtgttgcctgtggtcttggtcccgcggagaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20842 - RNA, 1070 nt, synthetic construct
  misc_feature 1..1070: note = mRNA product Design g-1 comprising derived and/or modified sequence from HRSV(Memphis-37)__AIY60637.1__P (opt3)
  source 1..1070: mol_type = other RNA
gggagactttcccattctgtagcagaatttggtgttgcctgtggtcttggtcccgcggagaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20843 - RNA, 1070 nt, synthetic construct
  misc_feature 1..1070: note = mRNA product Design g-1 comprising derived and/or modified sequence from HRSV(Memphis-37)__AIY60637.1__P (opt4)
  source 1..1070: mol_type = other RNA
gggagactttcccattctgtagcagaatttggtgttgcctgtggtcttggtcccgcggagaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20844 - RNA, 1070 nt, synthetic construct
  misc_feature 1..1070: note = mRNA product Design g-1 comprising derived and/or modified sequence from HRSV(Memphis-37)__AIY60637.1__P (opt5)
  source 1..1070: mol_type = other RNA
gggagactttcccattctgtagcagaatttggtgttgcctgtggtcttggtcccgcggagaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20845 - RNA, 1070 nt, synthetic construct
  misc_feature 1..1070: note = mRNA product Design g-1 comprising derived and/or modified sequence from HRSV(Memphis-37)__AIY60637.1__P (opt6)
  source 1..1070: mol_type = other RNA
gggagactttcccattctgtagcagaatttggtgttgcctgtggtcttggtcccgcggagaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20846 - RNA, 1070 nt, synthetic construct
  misc_feature 1..1070: note = mRNA product Design g-1 comprising derived and/or modified sequence from HRSV(Memphis-37)__AIY60637.1__P (opt11)
  source 1..1070: mol_type = other RNA
gggagactttcccattctgtagcagaatttggtgttgcctgtggtcttggtcccgcggagaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20847 - RNA, 1085 nt, synthetic construct
  misc_feature 1..1085: note = mRNA product Design g-2 comprising derived and/or modified sequence from HRSV(Memphis-37)__AIY60637.1__P (wt)
  source 1..1085: mol_type = other RNA
gggagagtccgctcagccaggttgcagaagcggcttagcgtgtgtcctaatcttctctctgcgtgtaggtaggcctgtgccgcaaacaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20848 - RNA, 1085 nt, synthetic construct
  misc_feature 1..1085: note = mRNA product Design g-2 comprising derived and/or modified sequence from HRSV(Memphis-37)__AIY60637.1__P (opt1)
  source 1..1085: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20849 - RNA, 1085 nt, synthetic construct
  misc_feature 1..1085: note = mRNA product Design g-2 comprising derived and/or modified sequence from HRSV(Memphis-37)__AIY60637.1__P (opt2)
  source 1..1085: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20850 - RNA, 1085 nt, synthetic construct
  misc_feature 1..1085: note = mRNA product Design g-2 comprising derived and/or modified sequence from HRSV(Memphis-37)__AIY60637.1__P (opt3)
  source 1..1085: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20851 - RNA, 1085 nt, synthetic construct
  misc_feature 1..1085: note = mRNA product Design g-2 comprising derived and/or modified sequence from HRSV(Memphis-37)__AIY60637.1__P (opt4)
  source 1..1085: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20852 - RNA, 1085 nt, synthetic construct
  misc_feature 1..1085: note = mRNA product Design g-2 comprising derived and/or modified sequence from HRSV(Memphis-37)__AIY60637.1__P (opt5)
  source 1..1085: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20853 - RNA, 1085 nt, synthetic construct
  misc_feature 1..1085: note = mRNA product Design g-2 comprising derived and/or modified sequence from HRSV(Memphis-37)__AIY60637.1__P (opt6)
  source 1..1085: mol_type = other RNA
gggagagtccgctcagccaggttgcagaagcggcttagcgtgtgtcctaatcttctctctgcgtgtaggtaggcctgtgccgcaaacaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20854 - RNA, 1085 nt, synthetic construct
  misc_feature 1..1085: note = mRNA product Design g-2 comprising derived and/or modified sequence from HRSV(Memphis-37)__AIY60637.1__P (opt11)
  source 1..1085: mol_type = other RNA
gggagagtccgctcagccaggttgcagaagcggcttagcgtgtgtcctaatcttctctctgcgtgtaggtaggcctgtgccgcaaacaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20855 - RNA, 1317 nt, synthetic construct
  misc_feature 1..1317: note = mRNA product Design g-3 comprising derived and/or modified sequence from HRSV(Memphis-37)__AIY60637.1__P (wt)
  source 1..1317: mol_type = other RNA
gggagagtccgctcagccaggttgcagaagcggcttagcgtgtgtcctaatcttctctctgcgtgtaggtaggcctgtgccgcaaacaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20856 - RNA, 1317 nt, synthetic construct
  misc_feature 1..1317: note = mRNA product Design g-3 comprising derived and/or modified sequence from HRSV(Memphis-37)__AIY60637.1__P (opt1)
  source 1..1317: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20857 - RNA, 1317 nt, synthetic construct
  misc_feature 1..1317: note = mRNA product Design g-3 comprising derived and/or modified sequence from HRSV(Memphis-37)__AIY60637.1__P (opt2)
  source 1..1317: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20858 - RNA, 1317 nt, synthetic construct
  misc_feature 1..1317: note = mRNA product Design g-3 comprising derived and/or modified sequence from HRSV(Memphis-37)__AIY60637.1__P (opt3)
  source 1..1317: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20859 - RNA, 1317 nt, synthetic construct
  misc_feature 1..1317: note = mRNA product Design g-3 comprising derived and/or modified sequence from HRSV(Memphis-37)__AIY60637.1__P (opt4)
  source 1..1317: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20860 - RNA, 1317 nt, synthetic construct
  misc_feature 1..1317: note = mRNA product Design g-3 comprising derived and/or modified sequence from HRSV(Memphis-37)__AIY60637.1__P (opt5)
  source 1..1317: mol_type = other RNA
gggagagtccgctcagccaggttgcagaagcggcttagcgtgtgtcctaatcttctctctgcgtgtaggtaggcctgtgccgcaaacaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20861 - RNA, 1317 nt, synthetic construct
  misc_feature 1..1317: note = mRNA product Design g-3 comprising derived and/or modified sequence from HRSV(Memphis-37)__AIY60637.1__P (opt6)
  source 1..1317: mol_type = other RNA
gggagagtccgctcagccaggttgcagaagcggcttagcgtgtgtcctaatcttctctctgcgtgtaggtaggcctgtgccgcaaacaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20862 - RNA, 1317 nt, synthetic construct
  misc_feature 1..1317: note = mRNA product Design g-3 comprising derived and/or modified sequence from HRSV(Memphis-37)__AIY60637.1__P (opt11)
  source 1..1317: mol_type = other RNA
gggagagtccgctcagccaggttgcagaagcggcttagcgtgtgtcctaatcttctctctgcgtgtaggtaggcctgtgccgcaaacaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20863 - RNA, 1112 nt, synthetic construct
  misc_feature 1..1112: note = mRNA product Design g-4 comprising derived and/or modified sequence from HRSV(Memphis-37)__AIY60637.1__P (wt)
  source 1..1112: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20864 - RNA, 1112 nt, synthetic construct
  misc_feature 1..1112: note = mRNA product Design g-4 comprising derived and/or modified sequence from HRSV(Memphis-37)__AIY60637.1__P (opt1)
  source 1..1112: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20865 - RNA, 1112 nt, synthetic construct
  misc_feature 1..1112: note = mRNA product Design g-4 comprising derived and/or modified sequence from HRSV(Memphis-37)__AIY60637.1__P (opt2)
  source 1..1112: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20866 - RNA, 1112 nt, synthetic construct
  misc_feature 1..1112: note = mRNA product Design g-4 comprising derived and/or modified sequence from HRSV(Memphis-37)__AIY60637.1__P (opt3)
  source 1..1112: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20867 - RNA, 1112 nt, synthetic construct
  misc_feature 1..1112: note = mRNA product Design g-4 comprising derived and/or modified sequence from HRSV(Memphis-37)__AIY60637.1__P (opt4)
  source 1..1112: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20868 - RNA, 1112 nt, synthetic construct
  misc_feature 1..1112: note = mRNA product Design g-4 comprising derived and/or modified sequence from HRSV(Memphis-37)__AIY60637.1__P (opt5)
  source 1..1112: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20869 - RNA, 1112 nt, synthetic construct
  misc_feature 1..1112: note = mRNA product Design g-4 comprising derived and/or modified sequence from HRSV(Memphis-37)__AIY60637.1__P (opt6)
  source 1..1112: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20870 - RNA, 1112 nt, synthetic construct
  misc_feature 1..1112: note = mRNA product Design g-4 comprising derived and/or modified sequence from HRSV(Memphis-37)__AIY60637.1__P (opt11)
  source 1..1112: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20871 - RNA, 1088 nt, synthetic construct
  misc_feature 1..1088: note = mRNA product Design g-5 comprising derived and/or modified sequence from HRSV(Memphis-37)__AIY60637.1__P (wt)
  source 1..1088: mol_type = other RNA
gggagacccgtgacccggaagttgtacggctacgcgactttccctcccacaaaccctcgcgcccttcctttcctacttgggcccggcagaaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20872 - RNA, 1088 nt, synthetic construct
  misc_feature 1..1088: note = mRNA product Design g-5 comprising derived and/or modified sequence from HRSV(Memphis-37)__AIY60637.1__P (opt1)
  source 1..1088: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20873 - RNA, 1088 nt, synthetic construct
  misc_feature 1..1088: note = mRNA product Design g-5 comprising derived and/or modified sequence from HRSV(Memphis-37)__AIY60637.1__P (opt2)
  source 1..1088: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20874 - RNA, 1088 nt, synthetic construct
  misc_feature 1..1088: note = mRNA product Design g-5 comprising derived and/or modified sequence from HRSV(Memphis-37)__AIY60637.1__P (opt3)
  source 1..1088: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20875 - RNA, 1088 nt, synthetic construct
  misc_feature 1..1088: note = mRNA product Design g-5 comprising derived and/or modified sequence from HRSV(Memphis-37)__AIY60637.1__P (opt4)
  source 1..1088: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20876 - RNA, 1088 nt, synthetic construct
  misc_feature 1..1088: note = mRNA product Design g-5 comprising derived and/or modified sequence from HRSV(Memphis-37)__AIY60637.1__P (opt5)
  source 1..1088: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20877 - RNA, 1088 nt, synthetic construct
  misc_feature 1..1088: note = mRNA product Design g-5 comprising derived and/or modified sequence from HRSV(Memphis-37)__AIY60637.1__P (opt6)
  source 1..1088: mol_type = other RNA
gggagacccgtgacccggaagttgtacggctacgcgactttccctcccacaaaccctcgcgcccttcctttcctacttgggcccggcagaaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20878 - RNA, 1088 nt, synthetic construct
  misc_feature 1..1088: note = mRNA product Design g-5 comprising derived and/or modified sequence from HRSV(Memphis-37)__AIY60637.1__P (opt11)
  source 1..1088: mol_type = other RNA
gggagacccgtgacccggaagttgtacggctacgcgactttccctcccacaaaccctcgcgcccttcctttcctacttgggcccggcagaaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20879 - RNA, 1104 nt, synthetic construct
  misc_feature 1..1104: note = mRNA product Design h-1 comprising derived and/or modified sequence from HRSV(Memphis-37)__AIY60637.1__P (wt)
  source 1..1104: mol_type = other RNA
gggagacccgtgacccggaagttgtacggctacgcgactttccctcccacaaaccctcgcgcccttcctttcctacttgggcccggcagaaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20880 - RNA, 1104 nt, synthetic construct
  misc_feature 1..1104: note = mRNA product Design h-1 comprising derived and/or modified sequence from HRSV(Memphis-37)__AIY60637.1__P (opt1)
  source 1..1104: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20881 - RNA, 1104 nt, synthetic construct
  misc_feature 1..1104: note = mRNA product Design h-1 comprising derived and/or modified sequence from HRSV(Memphis-37)__AIY60637.1__P (opt2)
  source 1..1104: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20882 - RNA, 1104 nt, synthetic construct
  misc_feature 1..1104: note = mRNA product Design h-1 comprising derived and/or modified sequence from HRSV(Memphis-37)__AIY60637.1__P (opt3)
  source 1..1104: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20883 - RNA, 1104 nt, synthetic construct
  misc_feature 1..1104: note = mRNA product Design h-1 comprising derived and/or modified sequence from HRSV(Memphis-37)__AIY60637.1__P (opt4)
  source 1..1104: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20884 - RNA, 1104 nt, synthetic construct
  misc_feature 1..1104: note = mRNA product Design h-1 comprising derived and/or modified sequence from HRSV(Memphis-37)__AIY60637.1__P (opt5)
  source 1..1104: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20885 - RNA, 1104 nt, synthetic construct
  misc_feature 1..1104: note = mRNA product Design h-1 comprising derived and/or modified sequence from HRSV(Memphis-37)__AIY60637.1__P (opt6)
  source 1..1104: mol_type = other RNA
gggagacccgtgacccggaagttgtacggctacgcgactttccctcccacaaaccctcgcgcccttcctttcctacttgggcccggcagaaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20886 - RNA, 1104 nt, synthetic construct
  misc_feature 1..1104: note = mRNA product Design h-1 comprising derived and/or modified sequence from HRSV(Memphis-37)__AIY60637.1__P (opt11)
  source 1..1104: mol_type = other RNA
gggagacccgtgacccggaagttgtacggctacgcgactttccctcccacaaaccctcgcgcccttcctttcctacttgggcccggcagaaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20887 - RNA, 1320 nt, synthetic construct
  misc_feature 1..1320: note = mRNA product Design h-2 comprising derived and/or modified sequence from HRSV(Memphis-37)__AIY60637.1__P (wt)
  source 1..1320: mol_type = other RNA
gggagacccgtgacccggaagttgtacggctacgcgactttccctcccacaaaccctcgcgcccttcctttcctacttgggcccggcagaaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20888 - RNA, 1320 nt, synthetic construct
  misc_feature 1..1320: note = mRNA product Design h-2 comprising derived and/or modified sequence from HRSV(Memphis-37)__AIY60637.1__P (opt1)
  source 1..1320: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20889 - RNA, 1320 nt, synthetic construct
  misc_feature 1..1320: note = mRNA product Design h-2 comprising derived and/or modified sequence from HRSV(Memphis-37)__AIY60637.1__P (opt2)
  source 1..1320: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20890 - RNA, 1320 nt, synthetic construct
  misc_feature 1..1320: note = mRNA product Design h-2 comprising derived and/or modified sequence from HRSV(Memphis-37)__AIY60637.1__P (opt3)
  source 1..1320: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20891 - RNA, 1320 nt, synthetic construct
  misc_feature 1..1320: note = mRNA product Design h-2 comprising derived and/or modified sequence from HRSV(Memphis-37)__AIY60637.1__P (opt4)
  source 1..1320: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20892 - RNA, 1320 nt, synthetic construct
  misc_feature 1..1320: note = mRNA product Design h-2 comprising derived and/or modified sequence from HRSV(Memphis-37)__AIY60637.1__P (opt5)
  source 1..1320: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20893 - RNA, 1320 nt, synthetic construct
  misc_feature 1..1320: note = mRNA product Design h-2 comprising derived and/or modified sequence from HRSV(Memphis-37)__AIY60637.1__P (opt6)
  source 1..1320: mol_type = other RNA
gggagacccgtgacccggaagttgtacggctacgcgactttccctcccacaaaccctcgcgcccttcctttcctacttgggcccggcagaaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20894 - RNA, 1320 nt, synthetic construct
  misc_feature 1..1320: note = mRNA product Design h-2 comprising derived and/or modified sequence from HRSV(Memphis-37)__AIY60637.1__P (opt11)
  source 1..1320: mol_type = other RNA
gggagacccgtgacccggaagttgtacggctacgcgactttccctcccacaaaccctcgcgcccttcctttcctacttgggcccggcagaaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20895 - RNA, 1100 nt, synthetic construct
  misc_feature 1..1100: note = mRNA product Design h-3 comprising derived and/or modified sequence from HRSV(Memphis-37)__AIY60637.1__P (wt)
  source 1..1100: mol_type = other RNA
gggagacccgtgacccggaagttgtacggctacgcgactttccctcccacaaaccctcgcgcccttcctttcctacttgggcccggcagaaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20896 - RNA, 1100 nt, synthetic construct
  misc_feature 1..1100: note = mRNA product Design h-3 comprising derived and/or modified sequence from HRSV(Memphis-37)__AIY60637.1__P (opt1)
  source 1..1100: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20897 - RNA, 1100 nt, synthetic construct
  misc_feature 1..1100: note = mRNA product Design h-3 comprising derived and/or modified sequence from HRSV(Memphis-37)__AIY60637.1__P (opt2)
  source 1..1100: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20898 - RNA, 1100 nt, synthetic construct
  misc_feature 1..1100: note = mRNA product Design h-3 comprising derived and/or modified sequence from HRSV(Memphis-37)__AIY60637.1__P (opt3)
  source 1..1100: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20899 - RNA, 1100 nt, synthetic construct
  misc_feature 1..1100: note = mRNA product Design h-3 comprising derived and/or modified sequence from HRSV(Memphis-37)__AIY60637.1__P (opt4)
  source 1..1100: mol_type = other RNA
gggagacccgtgacccggaagttgtacggctacgcgactttccctcccacaaaccctcgcgcccttcctttcctacttgggcccggcagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20900 - RNA, 1100 nt, synthetic construct
  misc_feature 1..1100: note = mRNA product Design h-3 comprising derived and/or modified sequence from HRSV(Memphis-37)__AIY60637.1__P (opt5)
  source 1..1100: mol_type = other RNA
gggagacccgtgacccggaagttgtacggctacgcgactttccctcccacaaaccctcgcgcccttcctttcctacttgggcccggcagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20901 - RNA, 1100 nt, synthetic construct
  misc_feature 1..1100: note = mRNA product Design h-3 comprising derived and/or modified sequence from HRSV(Memphis-37)__AIY60637.1__P (opt6)
  source 1..1100: mol_type = other RNA
gggagacccgtgacccggaagttgtacggctacgcgactttccctcccacaaaccctcgcgcccttcctttcctacttgggcccggcagaaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20902 - RNA, 1100 nt, synthetic construct
  misc_feature 1..1100: note = mRNA product Design h-3 comprising derived and/or modified sequence from HRSV(Memphis-37)__AIY60637.1__P (opt11)
  source 1..1100: mol_type = other RNA
gggagacccgtgacccggaagttgtacggctacgcgactttccctcccacaaaccctcgcgcccttcctttcctacttgggcccggcagaaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20903 - RNA, 1163 nt, synthetic construct
  misc_feature 1..1163: note = mRNA product Design h-4 comprising derived and/or modified sequence from HRSV(Memphis-37)__AIY60637.1__P (wt)
  source 1..1163: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20904 - RNA, 1163 nt, synthetic construct
  misc_feature 1..1163: note = mRNA product Design h-4 comprising derived and/or modified sequence from HRSV(Memphis-37)__AIY60637.1__P (opt1)
  source 1..1163: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20905 - RNA, 1163 nt, synthetic construct
  misc_feature 1..1163: note = mRNA product Design h-4 comprising derived and/or modified sequence from HRSV(Memphis-37)__AIY60637.1__P (opt2)
  source 1..1163: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20906 - RNA, 1163 nt, synthetic construct
  misc_feature 1..1163: note = mRNA product Design h-4 comprising derived and/or modified sequence from HRSV(Memphis-37)__AIY60637.1__P (opt3)
  source 1..1163: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20907 - RNA, 1163 nt, synthetic construct
  misc_feature 1..1163: note = mRNA product Design h-4 comprising derived and/or modified sequence from HRSV(Memphis-37)__AIY60637.1__P (opt4)
  source 1..1163: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20908 - RNA, 1163 nt, synthetic construct
  misc_feature 1..1163: note = mRNA product Design h-4 comprising derived and/or modified sequence from HRSV(Memphis-37)__AIY60637.1__P (opt5)
  source 1..1163: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20909 - RNA, 1163 nt, synthetic construct
  misc_feature 1..1163: note = mRNA product Design h-4 comprising derived and/or modified sequence from HRSV(Memphis-37)__AIY60637.1__P (opt6)
  source 1..1163: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20910 - RNA, 1163 nt, synthetic construct
  misc_feature 1..1163: note = mRNA product Design h-4 comprising derived and/or modified sequence from HRSV(Memphis-37)__AIY60637.1__P (opt11)
  source 1..1163: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20911 - RNA, 1179 nt, synthetic construct
  misc_feature 1..1179: note = mRNA product Design h-5 comprising derived and/or modified sequence from HRSV(Memphis-37)__AIY60637.1__P (wt)
  source 1..1179: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20912 - RNA, 1179 nt, synthetic construct
  misc_feature 1..1179: note = mRNA product Design h-5 comprising derived and/or modified sequence from HRSV(Memphis-37)__AIY60637.1__P (opt1)
  source 1..1179: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20913 - RNA, 1179 nt, synthetic construct
  misc_feature 1..1179: note = mRNA product Design h-5 comprising derived and/or modified sequence from HRSV(Memphis-37)__AIY60637.1__P (opt2)
  source 1..1179: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20914 - RNA, 1179 nt, synthetic construct
  misc_feature 1..1179: note = mRNA product Design h-5 comprising derived and/or modified sequence from HRSV(Memphis-37)__AIY60637.1__P (opt3)
  source 1..1179: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20915 - RNA, 1179 nt, synthetic construct
  misc_feature 1..1179: note = mRNA product Design h-5 comprising derived and/or modified sequence from HRSV(Memphis-37)__AIY60637.1__P (opt4)
  source 1..1179: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20916 - RNA, 1179 nt, synthetic construct
  misc_feature 1..1179: note = mRNA product Design h-5 comprising derived and/or modified sequence from HRSV(Memphis-37)__AIY60637.1__P (opt5)
  source 1..1179: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20917 - RNA, 1179 nt, synthetic construct
  misc_feature 1..1179: note = mRNA product Design h-5 comprising derived and/or modified sequence from HRSV(Memphis-37)__AIY60637.1__P (opt6)
  source 1..1179: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20918 - RNA, 1179 nt, synthetic construct
  misc_feature 1..1179: note = mRNA product Design h-5 comprising derived and/or modified sequence from HRSV(Memphis-37)__AIY60637.1__P (opt11)
  source 1..1179: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20919 - RNA, 1112 nt, synthetic construct
  misc_feature 1..1112: note = mRNA product Design i-1 comprising derived and/or modified sequence from HRSV(Memphis-37)__AIY60637.1__P (wt)
  source 1..1112: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20920 - RNA, 1112 nt, synthetic construct
  misc_feature 1..1112: note = mRNA product Design i-1 comprising derived and/or modified sequence from HRSV(Memphis-37)__AIY60637.1__P (opt1)
  source 1..1112: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20921 - RNA, 1112 nt, synthetic construct
  misc_feature 1..1112: note = mRNA product Design i-1 comprising derived and/or modified sequence from HRSV(Memphis-37)__AIY60637.1__P (opt2)
  source 1..1112: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20922 - RNA, 1112 nt, synthetic construct
  misc_feature 1..1112: note = mRNA product Design i-1 comprising derived and/or modified sequence from HRSV(Memphis-37)__AIY60637.1__P (opt3)
  source 1..1112: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20923 - RNA, 1112 nt, synthetic construct
  misc_feature 1..1112: note = mRNA product Design i-1 comprising derived and/or modified sequence from HRSV(Memphis-37)__AIY60637.1__P (opt4)
  source 1..1112: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20924 - RNA, 1112 nt, synthetic construct
  misc_feature 1..1112: note = mRNA product Design i-1 comprising derived and/or modified sequence from HRSV(Memphis-37)__AIY60637.1__P (opt5)
  source 1..1112: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20925 - RNA, 1112 nt, synthetic construct
  misc_feature 1..1112: note = mRNA product Design i-1 comprising derived and/or modified sequence from HRSV(Memphis-37)__AIY60637.1__P (opt6)
  source 1..1112: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20926 - RNA, 1112 nt, synthetic construct
  misc_feature 1..1112: note = mRNA product Design i-1 comprising derived and/or modified sequence from HRSV(Memphis-37)__AIY60637.1__P (opt11)
  source 1..1112: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20927 - RNA, 1112 nt, synthetic construct
  misc_feature 1..1112: note = mRNA product Design i-2 comprising derived and/or modified sequence from HRSV(Memphis-37)__AIY60637.1__P (wt)
  source 1..1112: mol_type = other RNA
gggagaggcgctgcctacggaggtggcagccatctccttctcggcatcaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20928 - RNA, 1112 nt, synthetic construct
  misc_feature 1..1112: note = mRNA product Design i-2 comprising derived and/or modified sequence from HRSV(Memphis-37)__AIY60637.1__P (opt1)
  source 1..1112: mol_type = other RNA
gggagaggcgctgcctacggaggtggcagccatctccttctcggcatcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20929 - RNA, 1112 nt, synthetic construct
  misc_feature 1..1112: note = mRNA product Design i-2 comprising derived and/or modified sequence from HRSV(Memphis-37)__AIY60637.1__P (opt2)
  source 1..1112: mol_type = other RNA
gggagaggcgctgcctacggaggtggcagccatctccttctcggcatcaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20930 - RNA, 1112 nt, synthetic construct
  misc_feature 1..1112: note = mRNA product Design i-2 comprising derived and/or modified sequence from HRSV(Memphis-37)__AIY60637.1__P (opt3)
  source 1..1112: mol_type = other RNA
gggagaggcgctgcctacggaggtggcagccatctccttctcggcatcaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20931 - RNA, 1112 nt, synthetic construct
  misc_feature 1..1112: note = mRNA product Design i-2 comprising derived and/or modified sequence from HRSV(Memphis-37)__AIY60637.1__P (opt4)
  source 1..1112: mol_type = other RNA
gggagaggcgctgcctacggaggtggcagccatctccttctcggcatcaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20932 - RNA, 1112 nt, synthetic construct
  misc_feature 1..1112: note = mRNA product Design i-2 comprising derived and/or modified sequence from HRSV(Memphis-37)__AIY60637.1__P (opt5)
  source 1..1112: mol_type = other RNA
gggagaggcgctgcctacggaggtggcagccatctccttctcggcatcaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20933 - RNA, 1112 nt, synthetic construct
  misc_feature 1..1112: note = mRNA product Design i-2 comprising derived and/or modified sequence from HRSV(Memphis-37)__AIY60637.1__P (opt6)
  source 1..1112: mol_type = other RNA
gggagaggcgctgcctacggaggtggcagccatctccttctcggcatcaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20934 - RNA, 1112 nt, synthetic construct
  misc_feature 1..1112: note = mRNA product Design i-2 comprising derived and/or modified sequence from HRSV(Memphis-37)__AIY60637.1__P (opt11)
  source 1..1112: mol_type = other RNA
gggagaggcgctgcctacggaggtggcagccatctccttctcggcatcaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20935 - RNA, 1108 nt, synthetic construct
  misc_feature 1..1108: note = mRNA product Design i-2 comprising derived and/or modified sequence from HRSV(Memphis-37)__AIY60637.1__P (wt)
  source 1..1108: mol_type = other RNA
ggggcgctgcctacggaggtggcagccatctccttctcggcatcaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20936 - RNA, 1108 nt, synthetic construct
  misc_feature 1..1108: note = mRNA product Design i-2 comprising derived and/or modified sequence from HRSV(Memphis-37)__AIY60637.1__P (opt1)
  source 1..1108: mol_type = other RNA
ggggcgctgcctacggaggtggcagccatctccttctcggcatcaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20937 - RNA, 1108 nt, synthetic construct
  misc_feature 1..1108: note = mRNA product Design i-2 comprising derived and/or modified sequence from HRSV(Memphis-37)__AIY60637.1__P (opt2)
  source 1..1108: mol_type = other RNA
ggggcgctgcctacggaggtggcagccatctccttctcggcatcaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20938 - RNA, 1108 nt, synthetic construct
  misc_feature 1..1108: note = mRNA product Design i-2 comprising derived and/or modified sequence from HRSV(Memphis-37)__AIY60637.1__P (opt3)
  source 1..1108: mol_type = other RNA
ggggcgctgcctacggaggtggcagccatctccttctcggcatcaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20939 - RNA, 1108 nt, synthetic construct
  misc_feature 1..1108: note = mRNA product Design i-2 comprising derived and/or modified sequence from HRSV(Memphis-37)__AIY60637.1__P (opt4)
  source 1..1108: mol_type = other RNA
ggggcgctgcctacggaggtggcagccatctccttctcggcatcaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20940 - RNA, 1108 nt, synthetic construct
  misc_feature 1..1108: note = mRNA product Design i-2 comprising derived and/or modified sequence from HRSV(Memphis-37)__AIY60637.1__P (opt5)
  source 1..1108: mol_type = other RNA
ggggcgctgcctacggaggtggcagccatctccttctcggcatcaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20941 - RNA, 1108 nt, synthetic construct
  misc_feature 1..1108: note = mRNA product Design i-2 comprising derived and/or modified sequence from HRSV(Memphis-37)__AIY60637.1__P (opt6)
  source 1..1108: mol_type = other RNA
ggggcgctgcctacggaggtggcagccatctccttctcggcatcaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20942 - RNA, 1108 nt, synthetic construct
  misc_feature 1..1108: note = mRNA product Design i-2 comprising derived and/or modified sequence from HRSV(Memphis-37)__AIY60637.1__P (opt11)
  source 1..1108: mol_type = other RNA
ggggcgctgcctacggaggtggcagccatctccttctcggcatcaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20943 - RNA, 943 nt, synthetic construct
  misc_feature 1..943: note = mRNA product Design i-3 comprising derived and/or modified sequence from HRSV(Memphis-37)__AIY60637.1__P (wt)
  source 1..943: mol_type = other RNA
gggagaaagcttaccatggaaaagtttgctcctgaattccatggagaagacgcaaacaacagagccactaaattcctagaatcaataaagggcaaattcacatcacctaaagatcccaagaaaaaagatagtatcatatctgtcaactcaatagatatagaagtaaccaaagaaagccctataacttcaaattcaaccattataaaccctacaaatgagacagatgatactgcagggaacaagcccaattatcaaagaaaaccactagtgagtttcaaagaagaccctacgccaagtgataatcccttttcaaaactatacaaagaaaccatagaaacatttgataacaatgaagaagaatctagctattcatatgaagaaataaatgatcagacaaacgataatataacagcaagattagataggattgatgaaaaattaagtgaaatactaggaatgcttcacacactagtagtagcaagtgcaggacctacatctgctcgggatggtataagagatgccatggttggtttaagagaagaaatgatagaaaaaatcagaactgaagcattgatgaccaatgatagattagaagctatggcaagactcaggaatgaggaaagtgaaaagatggcaaaagacacatcagatgaagtgtctctcaatccaacatcagagaaattgaacaacctgttggaaggaaatgatagtgataatgatctatcacttgaagatttctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20944 - RNA, 943 nt, synthetic construct
  misc_feature 1..943: note = mRNA product Design i-3 comprising derived and/or modified sequence from HRSV(Memphis-37)__AIY60637.1__P (opt1)
  source 1..943: mol_type = other RNA
gggagaaagcttaccatggagaagttcgcccccgagttccacggcgaggacgccaacaaccgcgcgaccaagttcctggagagcatcaaggggaagttcacctccccgaaggaccccaagaagaaggacagcatcatctccgtgaacagcatcgacatcgaggtcacgaaggagtcccccatcaccagcaactccaccatcatcaaccccaccaacgagacggacgacaccgccggcaacaagccgaactaccagcggaagcccctcgtgagcttcaaggaggaccccaccccctccgacaacccgttcagcaagctgtacaaggagaccatcgagacgttcgacaacaacgaggaggagtccagctactcctacgaggagatcaacgaccagaccaacgacaacatcaccgcccgcctggaccggatcgacgagaagctcagcgagatcctggggatgctgcacaccctcgtggtcgcctccgccggccccacgagcgcgcgcgacgggatccgggacgccatggtgggcctgcgcgaggagatgatcgagaagatccggaccgaggccctgatgaccaacgaccgcctcgaggccatggcgcggctgcgcaacgaggagtccgagaagatggccaaggacaccagcgacgaggtgtccctgaaccccacgagcgagaagctcaacaacctgctggagggcaacgacagcgacaacgacctctccctggaggacttctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20945 - RNA, 943 nt, synthetic construct
  misc_feature 1..943: note = mRNA product Design i-3 comprising derived and/or modified sequence from HRSV(Memphis-37)__AIY60637.1__P (opt2)
  source 1..943: mol_type = other RNA
gggagaaagcttaccatggagaagttcgcccccgagttccacggcgaggacgccaacaaccgcgccaccaagttcctcgagtccatcaagggcaagttcacctcccccaaggaccccaagaagaaggactccatcatctccgtcaactccatcgacatcgaggtcaccaaggagtcccccatcacctccaactccaccatcatcaaccccaccaacgagaccgacgacaccgccggcaacaagcccaactaccagcgcaagcccctcgtctccttcaaggaggaccccaccccctccgacaaccccttctccaagctctacaaggagaccatcgagaccttcgacaacaacgaggaggagtcctcctactcctacgaggagatcaacgaccagaccaacgacaacatcaccgcccgcctcgaccgcatcgacgagaagctctccgagatcctcggcatgctccacaccctcgtcgtcgcctccgccggccccacctccgcccgcgacggcatccgcgacgccatggtcggcctccgcgaggagatgatcgagaagatccgcaccgaggccctcatgaccaacgaccgcctcgaggccatggcccgcctccgcaacgaggagtccgagaagatggccaaggacacctccgacgaggtctccctcaaccccacctccgagaagctcaacaacctcctcgagggcaacgactccgacaacgacctctccctcgaggacttctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20946 - RNA, 943 nt, synthetic construct
  misc_feature 1..943: note = mRNA product Design i-3 comprising derived and/or modified sequence from HRSV(Memphis-37)__AIY60637.1__P (opt3)
  source 1..943: mol_type = other RNA
gggagaaagcttaccatggagaagttcgcccccgaatttcacggcgaggacgctaacaatagagcaaccaaattcctggaaagcatcaaggggaaatttacatcccctaaggatccgaaaaagaaggactctattatatcagtgaacagtatcgatattgaggtcactaaagaaagcccaatcacgtccaattctaccattatcaaccccacaaatgagactgacgataccgccggaaacaagcctaattaccagaggaaaccactcgtttcgttcaaggaggaccccacaccttcagataacccatttagcaaactttataaggaaaccatagagactttcgacaataacgaagaggagagttcctactcttatgaagagatcaatgatcaaacaaacgacaatattaccgcgcggctggatcgcatcgacgaaaagttgagcgagattttaggtatgctgcatacgctagtggtagcttccgccggccccacttcagcacgagatgggatccgtgacgccatggtgggactcagagaagagatgatagagaaaattaggaccgaagctctgatgacaaacgaccggcttgaggcaatggcccgcctgagaaatgaagagagtgaaaagatggctaaagatactagcgacgaggtctctttgaaccctacctccgagaagctcaacaatctgctggaaggcaacgattcagacaatgatctcagcttagaggacttttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20947 - RNA, 943 nt, synthetic construct
  misc_feature 1..943: note = mRNA product Design i-3 comprising derived and/or modified sequence from HRSV(Memphis-37)__AIY60637.1__P (opt4)
  source 1..943: mol_type = other RNA
gggagaaagcttaccatggagaagttcgcccccgagttccacggcgaggacgccaacaacagagccaccaagttcctggagagcatcaagggcaagttcaccagccccaaggaccccaagaagaaggacagcatcatcagcgtgaacagcatcgacatcgaggtgaccaaggagagccccatcaccagcaacagcaccatcatcaaccccaccaacgagaccgacgacaccgccggcaacaagcccaactaccagagaaagcccctggtgagcttcaaggaggaccccacccccagcgacaaccccttcagcaagctgtacaaggagaccatcgagaccttcgacaacaacgaggaggagagcagctacagctacgaggagatcaacgaccagaccaacgacaacatcaccgccagactggacagaatcgacgagaagctgagcgagatcctgggcatgctgcacaccctggtggtggccagcgccggccccaccagcgccagagacggcatcagagacgccatggtgggcctgagagaggagatgatcgagaagatcagaaccgaggccctgatgaccaacgacagactggaggccatggccagactgagaaacgaggagagcgagaagatggccaaggacaccagcgacgaggtgagcctgaaccccaccagcgagaagctgaacaacctgctggagggcaacgacagcgacaacgacctgagcctggaggacttctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20948 - RNA, 943 nt, synthetic construct
  misc_feature 1..943: note = mRNA product Design i-3 comprising derived and/or modified sequence from HRSV(Memphis-37)__AIY60637.1__P (opt5)
  source 1..943: mol_type = other RNA
gggagaaagcttaccatggagaagttcgcccccgaatttcacggcgaggacgctaacaatagagccaccaaattcctggaaagcatcaaggggaaatttacatcccctaaggatccgaaaaagaaggactctattatcagcgtgaactccattgatatcgaggtcacgaaagaatctcccattaccagcaattccacaatcatcaaccctaccaatgagacagacgataccgcgggaaacaagcccaattaccagcggaaacctctcgtttctttcaaggaggaccccacacctagcgataacccgttttccaaactgtataaggaaaccattgagacgttcgacaataacgaagaggagagctcttactcctatgaagagatcaatgatcaaaccaacgacaatattacagctcgccttgatagaatcgacgaaaagctgagcgagattctcggcatgctgcatacccttgtggtggcctctgccgggcccacatccgctcgggatggaatccgcgacgccatggtcggcctgagagaagagatgattgagaaaatccggaccgaagctctcatgacgaacgaccgcctggaggccatggcgagactgcggaatgaagagagcgaaaagatggccaaagatacatctgacgaggtgtccctcaaccctaccagcgagaagctgaacaatcttctggaagggaacgattccgacaatgatctctctctggaggacttttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20949 - RNA, 943 nt, synthetic construct
  misc_feature 1..943: note = mRNA product Design i-3 comprising derived and/or modified sequence from HRSV(Memphis-37)__AIY60637.1__P (opt6)
  source 1..943: mol_type = other RNA
gggagaaagcttaccatggaaaaattcgcaccagaattccacggagaagacgcaaacaacagagcaacaaaattcctagaatcaataaaaggaaaattcacaagcccaaaagatcccaaaaaaaaagactcaatcataagcgtaaactcaatagatatagaagtaacaaaagaaagtccaataacaagcaacagtacaataataaacccaacaaatgaaacagacgatacagcaggcaacaaaccaaactaccaaagaaaaccgctagtaagtttcaaagaagacccaacaccaagcgataacccattttcaaaattatacaaagaaacaatagaaacattcgacaacaacgaagaagaaagctcatactcatacgaagaaataaacgaccaaacaaacgacaacataacagcgagattagacagaatagacgaaaaactatcagaaatactaggcatgttacacacattagtagtagcaagcgcaggaccaacatcagcaagagacggaatccgagacgcaatggtaggactaagagaagaaatgatagaaaaaataagaacagaagcactaatgacaaacgacagactagaagccatggcaagactaagaaacgaagaatcagaaaaaatggcaaaagacacatcagacgaagtatcactaaacccaacaagcgaaaaactaaacaacctattagaaggaaacgacagcgacaacgacctatcactcgaagacttctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20950 - RNA, 943 nt, synthetic construct
  misc_feature 1..943: note = mRNA product Design i-3 comprising derived and/or modified sequence from HRSV(Memphis-37)__AIY60637.1__P (opt11)
  source 1..943: mol_type = other RNA
gggagaaagcttaccatggaaaaattcgccccagaatttcacggcgaagacgccaacaaccgagccaccaaattcctcgaatcaataaaaggcaaattcacatcccccaaagaccccaaaaaaaaagactcgatcatctccgtgaactcaatcgacatagaagtcaccaaagaaagccccatcacctccaacagcaccatcatcaaccccacaaacgaaacagacgacaccgccggcaacaaaccaaactaccaacgaaaacccctcgtcagcttcaaagaagaccccacaccaagcgacaaccccttctccaaactctacaaagaaacaatagaaaccttcgacaacaacgaagaagaaagctcgtactcatacgaagaaatcaacgaccaaaccaacgacaacatcaccgcccgcctcgaccgcatcgacgaaaaactctccgaaatcctcggaatgctccacacactcgtcgtcgccagcgccggccccacctcagcccgggacggcatccgcgacgccatggtgggcctccgcgaggaaatgatcgaaaaaatccgcacagaagccctcatgaccaacgaccgcctcgaagccatggcccgcctccgcaacgaagaatccgaaaaaatggccaaagacacctccgacgaagtctcactaaaccccacctccgaaaaactaaacaacctcctagaaggcaacgacagcgacaacgacctctccctagaagacttctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20951 - protein, 194 aa, synthetic construct; identical to SEQ ID NO: 11552
  REGION 1..194: note = derived and/or modified protein sequence (wt) from HRSV(Memphis-37)__AIY60641.1__M2-1

SEQ ID NO: 20952 - RNA, 585 nt, synthetic construct
  misc_feature 1..585: note = derived and/or modified CDS sequence (wt) from HRSV(Memphis-37)__AIY60641.1__M2-1
  source 1..585: mol_type = other RNA
atgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctga

SEQ ID NO: 20953 - RNA, 585 nt, synthetic construct
  misc_feature 1..585: note = derived and/or modified CDS sequence (opt1) from HRSV(Memphis-37)__AIY60641.1__M2-1
  source 1..585: mol_type = other RNA
atgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctga

SEQ ID NO: 20954 - RNA, 585 nt, synthetic construct
  misc_feature 1..585: note = derived and/or modified CDS sequence (opt2) from HRSV(Memphis-37)__AIY60641.1__M2-1
  source 1..585: mol_type = other RNA
atgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctga

SEQ ID NO: 20955 - RNA, 585 nt, synthetic construct
  misc_feature 1..585: note = derived and/or modified CDS sequence (opt3) from HRSV(Memphis-37)__AIY60641.1__M2-1
  source 1..585: mol_type = other RNA
atgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctga

SEQ ID NO: 20956 - RNA, 585 nt, synthetic construct
  misc_feature 1..585: note = derived and/or modified CDS sequence (opt4) from HRSV(Memphis-37)__AIY60641.1__M2-1
  source 1..585: mol_type = other RNA
atgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctga

SEQ ID NO: 20957 - RNA, 585 nt, synthetic construct
  misc_feature 1..585: note = derived and/or modified CDS sequence (opt5) from HRSV(Memphis-37)__AIY60641.1__M2-1
  source 1..585: mol_type = other RNA
atgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatga

SEQ ID NO: 20958 - RNA, 585 nt, synthetic construct
  misc_feature 1..585: note = derived and/or modified CDS sequence (opt6) from HRSV(Memphis-37)__AIY60641.1__M2-1
  source 1..585: mol_type = other RNA
atgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataa

SEQ ID NO: 20959 - RNA, 585 nt, synthetic construct
  misc_feature 1..585: note = derived and/or modified CDS sequence (opt11) from HRSV(Memphis-37)__AIY60641.1__M2-1
  source 1..585: mol_type = other RNA
atgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaa

SEQ ID NO: 20960 - RNA, 861 nt, synthetic construct
  misc_feature 1..861: note = mRNA product Design a-1 comprising derived and/or modified sequence from HRSV(Memphis-37)__AIY60641.1__M2-1 (wt)
  source 1..861: mol_type = other RNA
gggagagtcccgcagtcggcgtccagcggctctgcttgttcgtgtgtgtgtcgttgcaggccttattcaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20961 - RNA, 861 nt, synthetic construct
  misc_feature 1..861: note = mRNA product Design a-1 comprising derived and/or modified sequence from HRSV(Memphis-37)__AIY60641.1__M2-1 (opt1)
  source 1..861: mol_type = other RNA
gggagagtcccgcagtcggcgtccagcggctctgcttgttcgtgtgtgtgtcgttgcaggccttattcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20962 - RNA, 861 nt, synthetic construct
  misc_feature 1..861: note = mRNA product Design a-1 comprising derived and/or modified sequence from HRSV(Memphis-37)__AIY60641.1__M2-1 (opt2)
  source 1..861: mol_type = other RNA
gggagagtcccgcagtcggcgtccagcggctctgcttgttcgtgtgtgtgtcgttgcaggccttattcaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20963 - RNA, 861 nt, synthetic construct
  misc_feature 1..861: note = mRNA product Design a-1 comprising derived and/or modified sequence from HRSV(Memphis-37)__AIY60641.1__M2-1 (opt3)
  source 1..861: mol_type = other RNA
gggagagtcccgcagtcggcgtccagcggctctgcttgttcgtgtgtgtgtcgttgcaggccttattcaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20964 - RNA, 861 nt, synthetic construct
  misc_feature 1..861: note = mRNA product Design a-1 comprising derived and/or modified sequence from HRSV(Memphis-37)__AIY60641.1__M2-1 (opt4)
  source 1..861: mol_type = other RNA
gggagagtcccgcagtcggcgtccagcggctctgcttgttcgtgtgtgtgtcgttgcaggccttattcaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20965 - RNA, 861 nt, synthetic construct
  misc_feature 1..861: note = mRNA product Design a-1 comprising derived and/or modified sequence from HRSV(Memphis-37)__AIY60641.1__M2-1 (opt5)
  source 1..861: mol_type = other RNA
gggagagtcccgcagtcggcgtccagcggctctgcttgttcgtgtgtgtgtcgttgcaggccttattcaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20966 - RNA, 861 nt, synthetic construct
  misc_feature 1..861: note = mRNA product Design a-1 comprising derived and/or modified sequence from HRSV(Memphis-37)__AIY60641.1__M2-1 (opt6)
  source 1..861: mol_type = other RNA
gggagagtcccgcagtcggcgtccagcggctctgcttgttcgtgtgtgtgtcgttgcaggccttattcaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20967 - RNA, 861 nt, synthetic construct
  misc_feature 1..861: note = mRNA product Design a-1 comprising derived and/or modified sequence from HRSV(Memphis-37)__AIY60641.1__M2-1 (opt11)
  source 1..861: mol_type = other RNA
gggagagtcccgcagtcggcgtccagcggctctgcttgttcgtgtgtgtgtcgttgcaggccttattcaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20968 - RNA, 880 nt, synthetic construct
  misc_feature 1..880: note = mRNA product Design a-2 comprising derived and/or modified sequence from HRSV(Memphis-37)__AIY60641.1__M2-1 (wt)
  source 1..880: mol_type = other RNA
gggagagtccgctcagccaggttgcagaagcggcttagcgtgtgtcctaatcttctctctgcgtgtaggtaggcctgtgccgcaaacaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20969 - RNA, 880 nt, synthetic construct
  misc_feature 1..880: note = mRNA product Design a-2 comprising derived and/or modified sequence from HRSV(Memphis-37)__AIY60641.1__M2-1 (opt1)
  source 1..880: mol_type = other RNA
gggagagtccgctcagccaggttgcagaagcggcttagcgtgtgtcctaatcttctctctgcgtgtaggtaggcctgtgccgcaaacaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20970 - RNA, 880 nt, synthetic construct
  misc_feature 1..880: note = mRNA product Design a-2 comprising derived and/or modified sequence from HRSV(Memphis-37)__AIY60641.1__M2-1 (opt2)
  source 1..880: mol_type = other RNA
gggagagtccgctcagccaggttgcagaagcggcttagcgtgtgtcctaatcttctctctgcgtgtaggtaggcctgtgccgcaaacaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20971 - RNA, 880 nt, synthetic construct
  misc_feature 1..880: note = mRNA product Design a-2 comprising derived and/or modified sequence from HRSV(Memphis-37)__AIY60641.1__M2-1 (opt3)
  source 1..880: mol_type = other RNA
gggagagtccgctcagccaggttgcagaagcggcttagcgtgtgtcctaatcttctctctgcgtgtaggtaggcctgtgccgcaaacaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20972 - RNA, 880 nt, synthetic construct
  misc_feature 1..880: note = mRNA product Design a-2 comprising derived and/or modified sequence from HRSV(Memphis-37)__AIY60641.1__M2-1 (opt4)
  source 1..880: mol_type = other RNA
gggagagtccgctcagccaggttgcagaagcggcttagcgtgtgtcctaatcttctctctgcgtgtaggtaggcctgtgccgcaaacaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20973 - RNA, 880 nt, synthetic construct
  misc_feature 1..880: note = mRNA product Design a-2 comprising derived and/or modified sequence from HRSV(Memphis-37)__AIY60641.1__M2-1 (opt5)
  source 1..880: mol_type = other RNA
gggagagtccgctcagccaggttgcagaagcggcttagcgtgtgtcctaatcttctctctgcgtgtaggtaggcctgtgccgcaaacaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20974 - RNA, 880 nt, synthetic construct
  misc_feature 1..880: note = mRNA product Design a-2 comprising derived and/or modified sequence from HRSV(Memphis-37)__AIY60641.1__M2-1 (opt6)
  source 1..880: mol_type = other RNA
gggagagtccgctcagccaggttgcagaagcggcttagcgtgtgtcctaatcttctctctgcgtgtaggtaggcctgtgccgcaaacaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20975 - RNA, 880 nt, synthetic construct
  misc_feature 1..880: note = mRNA product Design a-2 comprising derived and/or modified sequence from HRSV(Memphis-37)__AIY60641.1__M2-1 (opt11)
  source 1..880: mol_type = other RNA
gggagagtccgctcagccaggttgcagaagcggcttagcgtgtgtcctaatcttctctctgcgtgtaggtaggcctgtgccgcaaacaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20976 - RNA, 958 nt, synthetic construct
  misc_feature 1..958: note = mRNA product Design a-3 comprising derived and/or modified sequence from HRSV(Memphis-37)__AIY60641.1__M2-1 (wt)
  source 1..958: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20977 - RNA, 958 nt, synthetic construct
  misc_feature 1..958: note = mRNA product Design a-3 comprising derived and/or modified sequence from HRSV(Memphis-37)__AIY60641.1__M2-1 (opt1)
  source 1..958: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20978 - RNA, 958 nt, synthetic construct
  misc_feature 1..958: note = mRNA product Design a-3 comprising derived and/or modified sequence from HRSV(Memphis-37)__AIY60641.1__M2-1 (opt2)
  source 1..958: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20979 - RNA, 958 nt, synthetic construct
  misc_feature 1..958: note = mRNA product Design a-3 comprising derived and/or modified sequence from HRSV(Memphis-37)__AIY60641.1__M2-1 (opt3)
  source 1..958: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20980 - RNA, 958 nt, synthetic construct
  misc_feature 1..958: note = mRNA product Design a-3 comprising derived and/or modified sequence from HRSV(Memphis-37)__AIY60641.1__M2-1 (opt4)
  source 1..958: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20981 - RNA, 958 nt, synthetic construct
  misc_feature 1..958: note = mRNA product Design a-3 comprising derived and/or modified sequence from HRSV(Memphis-37)__AIY60641.1__M2-1 (opt5)
  source 1..958: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20982 - RNA, 958 nt, synthetic construct
  misc_feature 1..958: note = mRNA product Design a-3 comprising derived and/or modified sequence from HRSV(Memphis-37)__AIY60641.1__M2-1 (opt6)
  source 1..958: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20983 - RNA, 958 nt, synthetic construct
  misc_feature 1..958: note = mRNA product Design a-3 comprising derived and/or modified sequence from HRSV(Memphis-37)__AIY60641.1__M2-1 (opt11)
  source 1..958: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20984 - RNA, 907 nt, synthetic construct
  misc_feature 1..907: note = mRNA product Design a-4 comprising derived and/or modified sequence from HRSV(Memphis-37)__AIY60641.1__M2-1 (wt)
  source 1..907: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20985 - RNA, 907 nt, synthetic construct
  misc_feature 1..907: note = mRNA product Design a-4 comprising derived and/or modified sequence from HRSV(Memphis-37)__AIY60641.1__M2-1 (opt1)
  source 1..907: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20986 - RNA, 907 nt, synthetic construct
  misc_feature 1..907: note = mRNA product Design a-4 comprising derived and/or modified sequence from HRSV(Memphis-37)__AIY60641.1__M2-1 (opt2)
  source 1..907: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20987 - RNA, 907 nt, synthetic construct
  misc_feature 1..907: note = mRNA product Design a-4 comprising derived and/or modified sequence from HRSV(Memphis-37)__AIY60641.1__M2-1 (opt3)
  source 1..907: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20988 - RNA, 907 nt, synthetic construct
  misc_feature 1..907: note = mRNA product Design a-4 comprising derived and/or modified sequence from HRSV(Memphis-37)__AIY60641.1__M2-1 (opt4)
  source 1..907: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20989 - RNA, 907 nt, synthetic construct
  misc_feature 1..907: note = mRNA product Design a-4 comprising derived and/or modified sequence from HRSV(Memphis-37)__AIY60641.1__M2-1 (opt5)
  source 1..907: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20990 - RNA, 907 nt, synthetic construct
  misc_feature 1..907: note = mRNA product Design a-4 comprising derived and/or modified sequence from HRSV(Memphis-37)__AIY60641.1__M2-1 (opt6)
  source 1..907: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20991 - RNA, 907 nt, synthetic construct
  misc_feature 1..907: note = mRNA product Design a-4 comprising derived and/or modified sequence from HRSV(Memphis-37)__AIY60641.1__M2-1 (opt11)
  source 1..907: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20992 - RNA, 853 nt, synthetic construct
  misc_feature 1..853: note = mRNA product Design a-5 comprising derived and/or modified sequence from HRSV(Memphis-37)__AIY60641.1__M2-1 (wt)
  source 1..853: mol_type = other RNA
gggagactttcccattctgtagcagaatttggtgttgcctgtggtcttggtcccgcggagaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20993 - RNA, 853 nt, synthetic construct
  misc_feature 1..853: note = mRNA product Design a-5 comprising derived and/or modified sequence from HRSV(Memphis-37)__AIY60641.1__M2-1 (opt1)
  source 1..853: mol_type = other RNA
gggagactttcccattctgtagcagaatttggtgttgcctgtggtcttggtcccgcggagaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20994 - RNA, 853 nt, synthetic construct
  misc_feature 1..853: note = mRNA product Design a-5 comprising derived and/or modified sequence from HRSV(Memphis-37)__AIY60641.1__M2-1 (opt2)
  source 1..853: mol_type = other RNA
gggagactttcccattctgtagcagaatttggtgttgcctgtggtcttggtcccgcggagaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20995 - RNA, 853 nt, synthetic construct
  misc_feature 1..853: note = mRNA product Design a-5 comprising derived and/or modified sequence from HRSV(Memphis-37)__AIY60641.1__M2-1 (opt3)
  source 1..853: mol_type = other RNA
gggagactttcccattctgtagcagaatttggtgttgcctgtggtcttggtcccgcggagaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20996 - RNA, 853 nt, synthetic construct
  misc_feature 1..853: note = mRNA product Design a-5 comprising derived and/or modified sequence from HRSV(Memphis-37)__AIY60641.1__M2-1 (opt4)
  source 1..853: mol_type = other RNA
gggagactttcccattctgtagcagaatttggtgttgcctgtggtcttggtcccgcggagaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20997 - RNA, 853 nt, synthetic construct
  misc_feature 1..853: note = mRNA product Design a-5 comprising derived and/or modified sequence from HRSV(Memphis-37)__AIY60641.1__M2-1 (opt5)
  source 1..853: mol_type = other RNA
gggagactttcccattctgtagcagaatttggtgttgcctgtggtcttggtcccgcggagaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20998 - RNA, 853 nt, synthetic construct
  misc_feature 1..853: note = mRNA product Design a-5 comprising derived and/or modified sequence from HRSV(Memphis-37)__AIY60641.1__M2-1 (opt6)
  source 1..853: mol_type = other RNA
gggagactttcccattctgtagcagaatttggtgttgcctgtggtcttggtcccgcggagaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 20999 - RNA, 853 nt, synthetic construct
  misc_feature 1..853: note = mRNA product Design a-5 comprising derived and/or modified sequence from HRSV(Memphis-37)__AIY60641.1__M2-1 (opt11)
  source 1..853: mol_type = other RNA
gggagactttcccattctgtagcagaatttggtgttgcctgtggtcttggtcccgcggagaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21000 - RNA, 1034 nt, synthetic construct
  misc_feature 1..1034: note = mRNA product Design b-1 comprising derived and/or modified sequence from HRSV(Memphis-37)__AIY60641.1__M2-1 (wt)
  source 1..1034: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21001 - RNA, 1034 nt, synthetic construct
  misc_feature 1..1034: note = mRNA product Design b-1 comprising derived and/or modified sequence from HRSV(Memphis-37)__AIY60641.1__M2-1 (opt1)
  source 1..1034: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21002 - RNA, 1034 nt, synthetic construct
  misc_feature 1..1034: note = mRNA product Design b-1 comprising derived and/or modified sequence from HRSV(Memphis-37)__AIY60641.1__M2-1 (opt2)
  source 1..1034: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21003 - RNA, 1034 nt, synthetic construct
  misc_feature 1..1034: note = mRNA product Design b-1 comprising derived and/or modified sequence from HRSV(Memphis-37)__AIY60641.1__M2-1 (opt3)
  source 1..1034: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21004 - RNA, 1034 nt, synthetic construct
  misc_feature 1..1034: note = mRNA product Design b-1 comprising derived and/or modified sequence from HRSV(Memphis-37)__AIY60641.1__M2-1 (opt4)
  source 1..1034: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21005 - RNA, 1034 nt, synthetic construct
  misc_feature 1..1034: note = mRNA product Design b-1 comprising derived and/or modified sequence from HRSV(Memphis-37)__AIY60641.1__M2-1 (opt5)
  source 1..1034: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21006 - RNA, 1034 nt, synthetic construct
  misc_feature 1..1034: note = mRNA product Design b-1 comprising derived and/or modified sequence from HRSV(Memphis-37)__AIY60641.1__M2-1 (opt6)
  source 1..1034: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21007 - RNA, 1034 nt, synthetic construct
  misc_feature 1..1034: note = mRNA product Design b-1 comprising derived and/or modified sequence from HRSV(Memphis-37)__AIY60641.1__M2-1 (opt11)
  source 1..1034: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21008 - RNA, 854 nt, synthetic construct
  misc_feature 1..854: note = mRNA product Design b-2 comprising derived and/or modified sequence from HRSV(Memphis-37)__AIY60641.1__M2-1 (wt)
  source 1..854: mol_type = other RNA
gggagagcctctgctggagtccggggagtggcgttggctgctagagcgaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21009 - RNA, 854 nt, synthetic construct
  misc_feature 1..854: note = mRNA product Design b-2 comprising derived and/or modified sequence from HRSV(Memphis-37)__AIY60641.1__M2-1 (opt1)
  source 1..854: mol_type = other RNA
gggagagcctctgctggagtccggggagtggcgttggctgctagagcgaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21010 - RNA, 854 nt, synthetic construct
  misc_feature 1..854: note = mRNA product Design b-2 comprising derived and/or modified sequence from HRSV(Memphis-37)__AIY60641.1__M2-1 (opt2)
  source 1..854: mol_type = other RNA
gggagagcctctgctggagtccggggagtggcgttggctgctagagcgaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21011 - RNA, 854 nt, synthetic construct
  misc_feature 1..854: note = mRNA product Design b-2 comprising derived and/or modified sequence from HRSV(Memphis-37)__AIY60641.1__M2-1 (opt3)
  source 1..854: mol_type = other RNA
gggagagcctctgctggagtccggggagtggcgttggctgctagagcgaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21012 - RNA, 854 nt, synthetic construct
  misc_feature 1..854: note = mRNA product Design b-2 comprising derived and/or modified sequence from HRSV(Memphis-37)__AIY60641.1__M2-1 (opt4)
  source 1..854: mol_type = other RNA
gggagagcctctgctggagtccggggagtggcgttggctgctagagcgaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21013 - RNA, 854 nt, synthetic construct
  misc_feature 1..854: note = mRNA product Design b-2 comprising derived and/or modified sequence from HRSV(Memphis-37)__AIY60641.1__M2-1 (opt5)
  source 1..854: mol_type = other RNA
gggagagcctctgctggagtccggggagtggcgttggctgctagagcgaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21014 - RNA, 854 nt, synthetic construct
  misc_feature 1..854: note = mRNA product Design b-2 comprising derived and/or modified sequence from HRSV(Memphis-37)__AIY60641.1__M2-1 (opt6)
  source 1..854: mol_type = other RNA
gggagagcctctgctggagtccggggagtggcgttggctgctagagcgaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21015 - RNA, 854 nt, synthetic construct
  misc_feature 1..854: note = mRNA product Design b-2 comprising derived and/or modified sequence from HRSV(Memphis-37)__AIY60641.1__M2-1 (opt11)
  source 1..854: mol_type = other RNA
gggagagcctctgctggagtccggggagtggcgttggctgctagagcgaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21016 - RNA, 874 nt, synthetic construct
  misc_feature 1..874: note = mRNA product Design b-3 comprising derived and/or modified sequence from HRSV(Memphis-37)__AIY60641.1__M2-1 (wt)
  source 1..874: mol_type = other RNA
gggagagtcccgcagtcggcgtccagcggctctgcttgttcgtgtgtgtgtcgttgcaggccttattcaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21017 - RNA, 874 nt, synthetic construct
  misc_feature 1..874: note = mRNA product Design b-3 comprising derived and/or modified sequence from HRSV(Memphis-37)__AIY60641.1__M2-1 (opt1)
  source 1..874: mol_type = other RNA
gggagagtcccgcagtcggcgtccagcggctctgcttgttcgtgtgtgtgtcgttgcaggccttattcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21018 - RNA, 874 nt, synthetic construct
  misc_feature 1..874: note = mRNA product Design b-3 comprising derived and/or modified sequence from HRSV(Memphis-37)__AIY60641.1__M2-1 (opt2)
  source 1..874: mol_type = other RNA
gggagagtcccgcagtcggcgtccagcggctctgcttgttcgtgtgtgtgtcgttgcaggccttattcaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21019 - RNA, 874 nt, synthetic construct
  misc_feature 1..874: note = mRNA product Design b-3 comprising derived and/or modified sequence from HRSV(Memphis-37)__AIY60641.1__M2-1 (opt3)
  source 1..874: mol_type = other RNA
gggagagtcccgcagtcggcgtccagcggctctgcttgttcgtgtgtgtgtcgttgcaggccttattcaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21020 - RNA, 874 nt, synthetic construct
  misc_feature 1..874: note = mRNA product Design b-3 comprising derived and/or modified sequence from HRSV(Memphis-37)__AIY60641.1__M2-1 (opt4)
  source 1..874: mol_type = other RNA
gggagagtcccgcagtcggcgtccagcggctctgcttgttcgtgtgtgtgtcgttgcaggccttattcaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21021 - RNA, 874 nt, synthetic construct
  misc_feature 1..874: note = mRNA product Design b-3 comprising derived and/or modified sequence from HRSV(Memphis-37)__AIY60641.1__M2-1 (opt5)
  source 1..874: mol_type = other RNA
gggagagtcccgcagtcggcgtccagcggctctgcttgttcgtgtgtgtgtcgttgcaggccttattcaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21022 - RNA, 874 nt, synthetic construct
  misc_feature 1..874: note = mRNA product Design b-3 comprising derived and/or modified sequence from HRSV(Memphis-37)__AIY60641.1__M2-1 (opt6)
  source 1..874: mol_type = other RNA
gggagagtcccgcagtcggcgtccagcggctctgcttgttcgtgtgtgtgtcgttgcaggccttattcaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21023 - RNA, 874 nt, synthetic construct
  misc_feature 1..874: note = mRNA product Design b-3 comprising derived and/or modified sequence from HRSV(Memphis-37)__AIY60641.1__M2-1 (opt11)
  source 1..874: mol_type = other RNA
gggagagtcccgcagtcggcgtccagcggctctgcttgttcgtgtgtgtgtcgttgcaggccttattcaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21024 - RNA, 925 nt, synthetic construct
  misc_feature 1..925: note = mRNA product Design b-4 comprising derived and/or modified sequence from HRSV(Memphis-37)__AIY60641.1__M2-1 (wt)
  source 1..925: mol_type = other RNA
gggagagtcccgcagtcggcgtccagcggctctgcttgttcgtgtgtgtgtcgttgcaggccttattcaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21025 - RNA, 925 nt, synthetic construct
  misc_feature 1..925: note = mRNA product Design b-4 comprising derived and/or modified sequence from HRSV(Memphis-37)__AIY60641.1__M2-1 (opt1)
  source 1..925: mol_type = other RNA
gggagagtcccgcagtcggcgtccagcggctctgcttgttcgtgtgtgtgtcgttgcaggccttattcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21026 - RNA, 925 nt, synthetic construct
  misc_feature 1..925: note = mRNA product Design b-4 comprising derived and/or modified sequence from HRSV(Memphis-37)__AIY60641.1__M2-1 (opt2)
  source 1..925: mol_type = other RNA
gggagagtcccgcagtcggcgtccagcggctctgcttgttcgtgtgtgtgtcgttgcaggccttattcaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21027 - RNA, 925 nt, synthetic construct
  misc_feature 1..925: note = mRNA product Design b-4 comprising derived and/or modified sequence from HRSV(Memphis-37)__AIY60641.1__M2-1 (opt3)
  source 1..925: mol_type = other RNA
gggagagtcccgcagtcggcgtccagcggctctgcttgttcgtgtgtgtgtcgttgcaggccttattcaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21028 - RNA, 925 nt, synthetic construct
  misc_feature 1..925: note = mRNA product Design b-4 comprising derived and/or modified sequence from HRSV(Memphis-37)__AIY60641.1__M2-1 (opt4)
  source 1..925: mol_type = other RNA
gggagagtcccgcagtcggcgtccagcggctctgcttgttcgtgtgtgtgtcgttgcaggccttattcaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21029 - RNA, 925 nt, synthetic construct
  misc_feature 1..925: note = mRNA product Design b-4 comprising derived and/or modified sequence from HRSV(Memphis-37)__AIY60641.1__M2-1 (opt5)
  source 1..925: mol_type = other RNA
gggagagtcccgcagtcggcgtccagcggctctgcttgttcgtgtgtgtgtcgttgcaggccttattcaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21030 - RNA, 925 nt, synthetic construct
  misc_feature 1..925: note = mRNA product Design b-4 comprising derived and/or modified sequence from HRSV(Memphis-37)__AIY60641.1__M2-1 (opt6)
  source 1..925: mol_type = other RNA
gggagagtcccgcagtcggcgtccagcggctctgcttgttcgtgtgtgtgtcgttgcaggccttattcaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21031 - RNA, 925 nt, synthetic construct
  misc_feature 1..925: note = mRNA product Design b-4 comprising derived and/or modified sequence from HRSV(Memphis-37)__AIY60641.1__M2-1 (opt11)
  source 1..925: mol_type = other RNA
gggagagtcccgcagtcggcgtccagcggctctgcttgttcgtgtgtgtgtcgttgcaggccttattcaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21032 - RNA, 987 nt, synthetic construct
  misc_feature 1..987: note = mRNA product Design b-5 comprising derived and/or modified sequence from HRSV(Memphis-37)__AIY60641.1__M2-1 (wt)
  source 1..987: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21033 - RNA, 987 nt, synthetic construct
  misc_feature 1..987: note = mRNA product Design b-5 comprising derived and/or modified sequence from HRSV(Memphis-37)__AIY60641.1__M2-1 (opt1)
  source 1..987: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21034 - RNA, 987 nt, synthetic construct
  misc_feature 1..987: note = mRNA product Design b-5 comprising derived and/or modified sequence from HRSV(Memphis-37)__AIY60641.1__M2-1 (opt2)
  source 1..987: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21035 - RNA, 987 nt, synthetic construct
  misc_feature 1..987: note = mRNA product Design b-5 comprising derived and/or modified sequence from HRSV(Memphis-37)__AIY60641.1__M2-1 (opt3)
  source 1..987: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21036 - RNA, 987 nt, synthetic construct
  misc_feature 1..987: note = mRNA product Design b-5 comprising derived and/or modified sequence from HRSV(Memphis-37)__AIY60641.1__M2-1 (opt4)
  source 1..987: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21037 - RNA, 987 nt, synthetic construct
  misc_feature 1..987: note = mRNA product Design b-5 comprising derived and/or modified sequence from HRSV(Memphis-37)__AIY60641.1__M2-1 (opt5)
  source 1..987: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21038 - RNA, 987 nt, synthetic construct
  misc_feature 1..987: note = mRNA product Design b-5 comprising derived and/or modified sequence from HRSV(Memphis-37)__AIY60641.1__M2-1 (opt6)
  source 1..987: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21039 - RNA, 987 nt, synthetic construct
  misc_feature 1..987: note = mRNA product Design b-5 comprising derived and/or modified sequence from HRSV(Memphis-37)__AIY60641.1__M2-1 (opt11)
  source 1..987: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21040 - RNA, 893 nt, synthetic construct
  misc_feature 1..893: note = mRNA product Design c-1 comprising derived and/or modified sequence from HRSV(Memphis-37)__AIY60641.1__M2-1 (wt)
  source 1..893: mol_type = other RNA
gggagagtccgctcagccaggttgcagaagcggcttagcgtgtgtcctaatcttctctctgcgtgtaggtaggcctgtgccgcaaacaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21041 - RNA, 893 nt, synthetic construct
  misc_feature 1..893: note = mRNA product Design c-1 comprising derived and/or modified sequence from HRSV(Memphis-37)__AIY60641.1__M2-1 (opt1)
  source 1..893: mol_type = other RNA
gggagagtccgctcagccaggttgcagaagcggcttagcgtgtgtcctaatcttctctctgcgtgtaggtaggcctgtgccgcaaacaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21042 - RNA, 893 nt, synthetic construct
  misc_feature 1..893: note = mRNA product Design c-1 comprising derived and/or modified sequence from HRSV(Memphis-37)__AIY60641.1__M2-1 (opt2)
  source 1..893: mol_type = other RNA
gggagagtccgctcagccaggttgcagaagcggcttagcgtgtgtcctaatcttctctctgcgtgtaggtaggcctgtgccgcaaacaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21043 - RNA, 893 nt, synthetic construct
  misc_feature 1..893: note = mRNA product Design c-1 comprising derived and/or modified sequence from HRSV(Memphis-37)__AIY60641.1__M2-1 (opt3)
  source 1..893: mol_type = other RNA
gggagagtccgctcagccaggttgcagaagcggcttagcgtgtgtcctaatcttctctctgcgtgtaggtaggcctgtgccgcaaacaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21044 - RNA, 893 nt, synthetic construct
  misc_feature 1..893: note = mRNA product Design c-1 comprising derived and/or modified sequence from HRSV(Memphis-37)__AIY60641.1__M2-1 (opt4)
  source 1..893: mol_type = other RNA
gggagagtccgctcagccaggttgcagaagcggcttagcgtgtgtcctaatcttctctctgcgtgtaggtaggcctgtgccgcaaacaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21045 - RNA, 893 nt, synthetic construct
  misc_feature 1..893: note = mRNA product Design c-1 comprising derived and/or modified sequence from HRSV(Memphis-37)__AIY60641.1__M2-1 (opt5)
  source 1..893: mol_type = other RNA
gggagagtccgctcagccaggttgcagaagcggcttagcgtgtgtcctaatcttctctctgcgtgtaggtaggcctgtgccgcaaacaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21046 - RNA, 893 nt, synthetic construct
  misc_feature 1..893: note = mRNA product Design c-1 comprising derived and/or modified sequence from HRSV(Memphis-37)__AIY60641.1__M2-1 (opt6)
  source 1..893: mol_type = other RNA
gggagagtccgctcagccaggttgcagaagcggcttagcgtgtgtcctaatcttctctctgcgtgtaggtaggcctgtgccgcaaacaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21047 - RNA, 893 nt, synthetic construct
  misc_feature 1..893: note = mRNA product Design c-1 comprising derived and/or modified sequence from HRSV(Memphis-37)__AIY60641.1__M2-1 (opt11)
  source 1..893: mol_type = other RNA
gggagagtccgctcagccaggttgcagaagcggcttagcgtgtgtcctaatcttctctctgcgtgtaggtaggcctgtgccgcaaacaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21048 - RNA, 983 nt, synthetic construct
  misc_feature 1..983: note = mRNA product Design c-2 comprising derived and/or modified sequence from HRSV(Memphis-37)__AIY60641.1__M2-1 (wt)
  source 1..983: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21049 - RNA, 983 nt, synthetic construct
  misc_feature 1..983: note = mRNA product Design c-2 comprising derived and/or modified sequence from HRSV(Memphis-37)__AIY60641.1__M2-1 (opt1)
  source 1..983: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21050 - RNA, 983 nt, synthetic construct
  misc_feature 1..983: note = mRNA product Design c-2 comprising derived and/or modified sequence from HRSV(Memphis-37)__AIY60641.1__M2-1 (opt2)
  source 1..983: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21051 - RNA, 983 nt, synthetic construct
  misc_feature 1..983: note = mRNA product Design c-2 comprising derived and/or modified sequence from HRSV(Memphis-37)__AIY60641.1__M2-1 (opt3)
  source 1..983: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21052 - RNA, 983 nt, synthetic construct
  misc_feature 1..983: note = mRNA product Design c-2 comprising derived and/or modified sequence from HRSV(Memphis-37)__AIY60641.1__M2-1 (opt4)
  source 1..983: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21053 - RNA, 983 nt, synthetic construct
  misc_feature 1..983: note = mRNA product Design c-2 comprising derived and/or modified sequence from HRSV(Memphis-37)__AIY60641.1__M2-1 (opt5)
  source 1..983: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21054 - RNA, 983 nt, synthetic construct
  misc_feature 1..983: note = mRNA product Design c-2 comprising derived and/or modified sequence from HRSV(Memphis-37)__AIY60641.1__M2-1 (opt6)
  source 1..983: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21055 - RNA, 983 nt, synthetic construct
  misc_feature 1..983: note = mRNA product Design c-2 comprising derived and/or modified sequence from HRSV(Memphis-37)__AIY60641.1__M2-1 (opt11)
  source 1..983: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21056 - RNA, 960 nt, synthetic construct
  misc_feature 1..960: note = mRNA product Design c-3 comprising derived and/or modified sequence from HRSV(Memphis-37)__AIY60641.1__M2-1 (wt)
  source 1..960: mol_type = other RNA
gggagagtccgctcagccaggttgcagaagcggcttagcgtgtgtcctaatcttctctctgcgtgtaggtaggcctgtgccgcaaacaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21057 - RNA, 960 nt, synthetic construct
  misc_feature 1..960: note = mRNA product Design c-3 comprising derived and/or modified sequence from HRSV(Memphis-37)__AIY60641.1__M2-1 (opt1)
  source 1..960: mol_type = other RNA
gggagagtccgctcagccaggttgcagaagcggcttagcgtgtgtcctaatcttctctctgcgtgtaggtaggcctgtgccgcaaacaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21058 - RNA, 960 nt, synthetic construct
  misc_feature 1..960: note = mRNA product Design c-3 comprising derived and/or modified sequence from HRSV(Memphis-37)__AIY60641.1__M2-1 (opt2)
  source 1..960: mol_type = other RNA
gggagagtccgctcagccaggttgcagaagcggcttagcgtgtgtcctaatcttctctctgcgtgtaggtaggcctgtgccgcaaacaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21059 - RNA, 960 nt, synthetic construct
  misc_feature 1..960: note = mRNA product Design c-3 comprising derived and/or modified sequence from HRSV(Memphis-37)__AIY60641.1__M2-1 (opt3)
  source 1..960: mol_type = other RNA
gggagagtccgctcagccaggttgcagaagcggcttagcgtgtgtcctaatcttctctctgcgtgtaggtaggcctgtgccgcaaacaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21060 - RNA, 960 nt, synthetic construct
  misc_feature 1..960: note = mRNA product Design c-3 comprising derived and/or modified sequence from HRSV(Memphis-37)__AIY60641.1__M2-1 (opt4)
  source 1..960: mol_type = other RNA
gggagagtccgctcagccaggttgcagaagcggcttagcgtgtgtcctaatcttctctctgcgtgtaggtaggcctgtgccgcaaacaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21061 - RNA, 960 nt, synthetic construct
  misc_feature 1..960: note = mRNA product Design c-3 comprising derived and/or modified sequence from HRSV(Memphis-37)__AIY60641.1__M2-1 (opt5)
  source 1..960: mol_type = other RNA
gggagagtccgctcagccaggttgcagaagcggcttagcgtgtgtcctaatcttctctctgcgtgtaggtaggcctgtgccgcaaacaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21062 - RNA, 960 nt, synthetic construct
  misc_feature 1..960: note = mRNA product Design c-3 comprising derived and/or modified sequence from HRSV(Memphis-37)__AIY60641.1__M2-1 (opt6)
  source 1..960: mol_type = other RNA
gggagagtccgctcagccaggttgcagaagcggcttagcgtgtgtcctaatcttctctctgcgtgtaggtaggcctgtgccgcaaacaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21063 - RNA, 960 nt, synthetic construct
  misc_feature 1..960: note = mRNA product Design c-3 comprising derived and/or modified sequence from HRSV(Memphis-37)__AIY60641.1__M2-1 (opt11)
  source 1..960: mol_type = other RNA
gggagagtccgctcagccaggttgcagaagcggcttagcgtgtgtcctaatcttctctctgcgtgtaggtaggcctgtgccgcaaacaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21064 - RNA, 956 nt, synthetic construct
  misc_feature 1..956: note = mRNA product Design c-4 comprising derived and/or modified sequence from HRSV(Memphis-37)__AIY60641.1__M2-1 (wt)
  source 1..956: mol_type = other RNA
gggagagtccgctcagccaggttgcagaagcggcttagcgtgtgtcctaatcttctctctgcgtgtaggtaggcctgtgccgcaaacaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21065 - RNA, 956 nt, synthetic construct
  misc_feature 1..956: note = mRNA product Design c-4 comprising derived and/or modified sequence from HRSV(Memphis-37)__AIY60641.1__M2-1 (opt1)
  source 1..956: mol_type = other RNA
gggagagtccgctcagccaggttgcagaagcggcttagcgtgtgtcctaatcttctctctgcgtgtaggtaggcctgtgccgcaaacaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21066 - RNA, 956 nt, synthetic construct
  misc_feature 1..956: note = mRNA product Design c-4 comprising derived and/or modified sequence from HRSV(Memphis-37)__AIY60641.1__M2-1 (opt2)
  source 1..956: mol_type = other RNA
gggagagtccgctcagccaggttgcagaagcggcttagcgtgtgtcctaatcttctctctgcgtgtaggtaggcctgtgccgcaaacaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21067 - RNA, 956 nt, synthetic construct
  misc_feature 1..956: note = mRNA product Design c-4 comprising derived and/or modified sequence from HRSV(Memphis-37)__AIY60641.1__M2-1 (opt3)
  source 1..956: mol_type = other RNA
gggagagtccgctcagccaggttgcagaagcggcttagcgtgtgtcctaatcttctctctgcgtgtaggtaggcctgtgccgcaaacaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21068 - RNA, 956 nt, synthetic construct
  misc_feature 1..956: note = mRNA product Design c-4 comprising derived and/or modified sequence from HRSV(Memphis-37)__AIY60641.1__M2-1 (opt4)
  source 1..956: mol_type = other RNA
gggagagtccgctcagccaggttgcagaagcggcttagcgtgtgtcctaatcttctctctgcgtgtaggtaggcctgtgccgcaaacaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21069 - RNA, 956 nt, synthetic construct
  misc_feature 1..956: note = mRNA product Design c-4 comprising derived and/or modified sequence from HRSV(Memphis-37)__AIY60641.1__M2-1 (opt5)
  source 1..956: mol_type = other RNA
gggagagtccgctcagccaggttgcagaagcggcttagcgtgtgtcctaatcttctctctgcgtgtaggtaggcctgtgccgcaaacaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21070 - RNA, 956 nt, synthetic construct
  misc_feature 1..956: note = mRNA product Design c-4 comprising derived and/or modified sequence from HRSV(Memphis-37)__AIY60641.1__M2-1 (opt6)
  source 1..956: mol_type = other RNA
gggagagtccgctcagccaggttgcagaagcggcttagcgtgtgtcctaatcttctctctgcgtgtaggtaggcctgtgccgcaaacaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21071 - RNA, 956 nt, synthetic construct
  misc_feature 1..956: note = mRNA product Design c-4 comprising derived and/or modified sequence from HRSV(Memphis-37)__AIY60641.1__M2-1 (opt11)
  source 1..956: mol_type = other RNA
gggagagtccgctcagccaggttgcagaagcggcttagcgtgtgtcctaatcttctctctgcgtgtaggtaggcctgtgccgcaaacaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21072 - RNA, 874 nt, synthetic construct
  misc_feature 1..874: note = mRNA product Design c-5 comprising derived and/or modified sequence from HRSV(Memphis-37)__AIY60641.1__M2-1 (wt)
  source 1..874: mol_type = other RNA
gggagagcggctcggccattttgtcccagtcagtccggaggctgcggctgcagaagtaccgcctgcggagtaactgcaaagaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21073 - RNA, 874 nt, synthetic construct
  misc_feature 1..874: note = mRNA product Design c-5 comprising derived and/or modified sequence from HRSV(Memphis-37)__AIY60641.1__M2-1 (opt1)
  source 1..874: mol_type = other RNA
gggagagcggctcggccattttgtcccagtcagtccggaggctgcggctgcagaagtaccgcctgcggagtaactgcaaagaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21074 - RNA, 874 nt, synthetic construct
  misc_feature 1..874: note = mRNA product Design c-5 comprising derived and/or modified sequence from HRSV(Memphis-37)__AIY60641.1__M2-1 (opt2)
  source 1..874: mol_type = other RNA
gggagagcggctcggccattttgtcccagtcagtccggaggctgcggctgcagaagtaccgcctgcggagtaactgcaaagaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21075 - RNA, 874 nt, synthetic construct
  misc_feature 1..874: note = mRNA product Design c-5 comprising derived and/or modified sequence from HRSV(Memphis-37)__AIY60641.1__M2-1 (opt3)
  source 1..874: mol_type = other RNA
gggagagcggctcggccattttgtcccagtcagtccggaggctgcggctgcagaagtaccgcctgcggagtaactgcaaagaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21076 - RNA, 874 nt, synthetic construct
  misc_feature 1..874: note = mRNA product Design c-5 comprising derived and/or modified sequence from HRSV(Memphis-37)__AIY60641.1__M2-1 (opt4)
  source 1..874: mol_type = other RNA
gggagagcggctcggccattttgtcccagtcagtccggaggctgcggctgcagaagtaccgcctgcggagtaactgcaaagaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21077 - RNA, 874 nt, synthetic construct
  misc_feature 1..874: note = mRNA product Design c-5 comprising derived and/or modified sequence from HRSV(Memphis-37)__AIY60641.1__M2-1 (opt5)
  source 1..874: mol_type = other RNA
gggagagcggctcggccattttgtcccagtcagtccggaggctgcggctgcagaagtaccgcctgcggagtaactgcaaagaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21078 - RNA, 874 nt, synthetic construct
  misc_feature 1..874: note = mRNA product Design c-5 comprising derived and/or modified sequence from HRSV(Memphis-37)__AIY60641.1__M2-1 (opt6)
  source 1..874: mol_type = other RNA
gggagagcggctcggccattttgtcccagtcagtccggaggctgcggctgcagaagtaccgcctgcggagtaactgcaaagaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21079 - RNA, 874 nt, synthetic construct
  misc_feature 1..874: note = mRNA product Design c-5 comprising derived and/or modified sequence from HRSV(Memphis-37)__AIY60641.1__M2-1 (opt11)
  source 1..874: mol_type = other RNA
gggagagcggctcggccattttgtcccagtcagtccggaggctgcggctgcagaagtaccgcctgcggagtaactgcaaagaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21080 - RNA, 883 nt, synthetic construct
  misc_feature 1..883: note = mRNA product Design d-1 comprising derived and/or modified sequence from HRSV(Memphis-37)__AIY60641.1__M2-1 (wt)
  source 1..883: mol_type = other RNA
gggagacccgtgacccggaagttgtacggctacgcgactttccctcccacaaaccctcgcgcccttcctttcctacttgggcccggcagaaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21081 - RNA, 883 nt, synthetic construct
  misc_feature 1..883: note = mRNA product Design d-1 comprising derived and/or modified sequence from HRSV(Memphis-37)__AIY60641.1__M2-1 (opt1)
  source 1..883: mol_type = other RNA
gggagacccgtgacccggaagttgtacggctacgcgactttccctcccacaaaccctcgcgcccttcctttcctacttgggcccggcagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21082 - RNA, 883 nt, synthetic construct
  misc_feature 1..883: note = mRNA product Design d-1 comprising derived and/or modified sequence from HRSV(Memphis-37)__AIY60641.1__M2-1 (opt2)
  source 1..883: mol_type = other RNA
gggagacccgtgacccggaagttgtacggctacgcgactttccctcccacaaaccctcgcgcccttcctttcctacttgggcccggcagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21083 - RNA, 883 nt, synthetic construct
  misc_feature 1..883: note = mRNA product Design d-1 comprising derived and/or modified sequence from HRSV(Memphis-37)__AIY60641.1__M2-1 (opt3)
  source 1..883: mol_type = other RNA
gggagacccgtgacccggaagttgtacggctacgcgactttccctcccacaaaccctcgcgcccttcctttcctacttgggcccggcagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21084 - RNA, 883 nt, synthetic construct
  misc_feature 1..883: note = mRNA product Design d-1 comprising derived and/or modified sequence from HRSV(Memphis-37)__AIY60641.1__M2-1 (opt4)
  source 1..883: mol_type = other RNA
gggagacccgtgacccggaagttgtacggctacgcgactttccctcccacaaaccctcgcgcccttcctttcctacttgggcccggcagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21085 - RNA, 883 nt, synthetic construct
  misc_feature 1..883: note = mRNA product Design d-1 comprising derived and/or modified sequence from HRSV(Memphis-37)__AIY60641.1__M2-1 (opt5)
  source 1..883: mol_type = other RNA
gggagacccgtgacccggaagttgtacggctacgcgactttccctcccacaaaccctcgcgcccttcctttcctacttgggcccggcagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21086 - RNA, 883 nt, synthetic construct
  misc_feature 1..883: note = mRNA product Design d-1 comprising derived and/or modified sequence from HRSV(Memphis-37)__AIY60641.1__M2-1 (opt6)
  source 1..883: mol_type = other RNA
gggagacccgtgacccggaagttgtacggctacgcgactttccctcccacaaaccctcgcgcccttcctttcctacttgggcccggcagaaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21087 - RNA, 883 nt, synthetic construct
  misc_feature 1..883: note = mRNA product Design d-1 comprising derived and/or modified sequence from HRSV(Memphis-37)__AIY60641.1__M2-1 (opt11)
  source 1..883: mol_type = other RNA
gggagacccgtgacccggaagttgtacggctacgcgactttccctcccacaaaccctcgcgcccttcctttcctacttgggcccggcagaaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21088 - RNA, 938 nt, synthetic construct
  misc_feature 1..938: note = mRNA product Design d-2 comprising derived and/or modified sequence from HRSV(Memphis-37)__AIY60641.1__M2-1 (wt)
  source 1..938: mol_type = other RNA
gggagagcggctcggccattttgtcccagtcagtccggaggctgcggctgcagaagtaccgcctgcggagtaactgcaaagaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21089 - RNA, 938 nt, synthetic construct
  misc_feature 1..938: note = mRNA product Design d-2 comprising derived and/or modified sequence from HRSV(Memphis-37)__AIY60641.1__M2-1 (opt1)
  source 1..938: mol_type = other RNA
gggagagcggctcggccattttgtcccagtcagtccggaggctgcggctgcagaagtaccgcctgcggagtaactgcaaagaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21090 - RNA, 938 nt, synthetic construct
  misc_feature 1..938: note = mRNA product Design d-2 comprising derived and/or modified sequence from HRSV(Memphis-37)__AIY60641.1__M2-1 (opt2)
  source 1..938: mol_type = other RNA
gggagagcggctcggccattttgtcccagtcagtccggaggctgcggctgcagaagtaccgcctgcggagtaactgcaaagaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21091 - RNA, 938 nt, synthetic construct
  misc_feature 1..938: note = mRNA product Design d-2 comprising derived and/or modified sequence from HRSV(Memphis-37)__AIY60641.1__M2-1 (opt3)
  source 1..938: mol_type = other RNA
gggagagcggctcggccattttgtcccagtcagtccggaggctgcggctgcagaagtaccgcctgcggagtaactgcaaagaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21092 - RNA, 938 nt, synthetic construct
  misc_feature 1..938: note = mRNA product Design d-2 comprising derived and/or modified sequence from HRSV(Memphis-37)__AIY60641.1__M2-1 (opt4)
  source 1..938: mol_type = other RNA
gggagagcggctcggccattttgtcccagtcagtccggaggctgcggctgcagaagtaccgcctgcggagtaactgcaaagaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21093 - RNA, 938 nt, synthetic construct
  misc_feature 1..938: note = mRNA product Design d-2 comprising derived and/or modified sequence from HRSV(Memphis-37)__AIY60641.1__M2-1 (opt5)
  source 1..938: mol_type = other RNA
gggagagcggctcggccattttgtcccagtcagtccggaggctgcggctgcagaagtaccgcctgcggagtaactgcaaagaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21094 - RNA, 938 nt, synthetic construct
  misc_feature 1..938: note = mRNA product Design d-2 comprising derived and/or modified sequence from HRSV(Memphis-37)__AIY60641.1__M2-1 (opt6)
  source 1..938: mol_type = other RNA
gggagagcggctcggccattttgtcccagtcagtccggaggctgcggctgcagaagtaccgcctgcggagtaactgcaaagaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21095 - RNA, 938 nt, synthetic construct
  misc_feature 1..938: note = mRNA product Design d-2 comprising derived and/or modified sequence from HRSV(Memphis-37)__AIY60641.1__M2-1 (opt11)
  source 1..938: mol_type = other RNA
gggagagcggctcggccattttgtcccagtcagtccggaggctgcggctgcagaagtaccgcctgcggagtaactgcaaagaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21096 - RNA, 1254 nt, synthetic construct
  misc_feature 1..1254: note = mRNA product Design d-3 comprising derived and/or modified sequence from HRSV(Memphis-37)__AIY60641.1__M2-1 (wt)
  source 1..1254: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21097 - RNA, 1254 nt, synthetic construct
  misc_feature 1..1254: note = mRNA product Design d-3 comprising derived and/or modified sequence from HRSV(Memphis-37)__AIY60641.1__M2-1 (opt1)
  source 1..1254: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21098 - RNA, 1254 nt, synthetic construct
  misc_feature 1..1254: note = mRNA product Design d-3 comprising derived and/or modified sequence from HRSV(Memphis-37)__AIY60641.1__M2-1 (opt2)
  source 1..1254: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcccgccgcaacccctgcaagttcgagatccgcggccactgcctcaacggcaagcgctgccacttctcccacaactacttcgagtggcccccccacgccctcctcgtccgccagaacttcatgctcaaccgcatcctcaagtccatggacaagtccatcgacaccctctccgagatctccggcgccgccgagctcgaccgcaccgaggagtacgccctcggcgtcgtcggcgtcctcgagtcctacatcggctccatcaacaacatcaccaagcagtccgcctgcgtcgccatgtccaagctcctcaccgagctcaactccgacgacatcaagaagctccgcgacaacgaggagcccaactcccccaagatccgcgtctacaacaccgtcatctcctacatcgagtccaaccgcaagaacaacaagcagaccatccacctcctcaagcgcctccccgccgacgtcctcaagaagaccatcaagaacaccctcgacatccacaagtccatcaccatcaacaaccccaaggagtccaccgtcaacgacaccaacgaccacgccaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21099 - RNA, 1254 nt, synthetic construct
  misc_feature 1..1254: note = mRNA product Design d-3 comprising derived and/or modified sequence from HRSV(Memphis-37)__AIY60641.1__M2-1 (opt3)
  source 1..1254: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaaggaacccctgcaagttcgagatccggggccactgtctgaatgggaaacgctgccatttttcccacaactacttcgaatggcctccacatgcactccttgtgcgacagaattttatgctgaaccgtattttgaagtctatggacaaatcaatagataccttaagtgagatcagcggagctgcagaactggacagaacagaggaatatgccctaggtgtcgttggcgtgctcgagtcctacattgggtctatcaataacattactaagcaatcggcgtgtgtagctatgtcaaaactgcttacggagctgaatagcgatgacatcaagaagttgagggataacgaggaaccgaatagtcccaaaatacgggtgtataacaccgtcatctcctacattgaatctaatcgcaagaacaataaacagacaatccacctcctgaagagactgcctgccgacgtgctcaaaaagactattaagaacaccttagatatccataaaagcataacaattaataacccaaaggagtccaccgttaacgacactaatgatcacgccaaaaacaatgacacaacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21100 - RNA, 1254 nt, synthetic construct
  misc_feature 1..1254: note = mRNA product Design d-3 comprising derived and/or modified sequence from HRSV(Memphis-37)__AIY60641.1__M2-1 (opt4)
  source 1..1254: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagaagaaacccctgcaagttcgagatcagaggccactgcctgaacggcaagagatgccacttcagccacaactacttcgagtggcccccccacgccctgctggtgagacagaacttcatgctgaacagaatcctgaagagcatggacaagagcatcgacaccctgagcgagatcagcggcgccgccgagctggacagaaccgaggagtacgccctgggcgtggtgggcgtgctggagagctacatcggcagcatcaacaacatcaccaagcagagcgcctgcgtggccatgagcaagctgctgaccgagctgaacagcgacgacatcaagaagctgagagacaacgaggagcccaacagccccaagatcagagtgtacaacaccgtgatcagctacatcgagagcaacagaaagaacaacaagcagaccatccacctgctgaagagactgcccgccgacgtgctgaagaagaccatcaagaacaccctggacatccacaagagcatcaccatcaacaaccccaaggagagcaccgtgaacgacaccaacgaccacgccaagaacaacgacaccacctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21101 - RNA, 1254 nt, synthetic construct
  misc_feature 1..1254: note = mRNA product Design d-3 comprising derived and/or modified sequence from HRSV(Memphis-37)__AIY60641.1__M2-1 (opt5)
  source 1..1254: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgagcagacggaacccctgcaagttcgagatccgcggccactgtctgaatgggaaaagatgccatttttcccacaactacttcgaatggcctccgcatgccctcctggtgcggcagaattttatgcttaaccgcattctgaagtctatggacaaaagcatcgataccctctccgagatttctggagctgccgaactggacagaacagaggaatatgcgcttggcgtcgttggggtgctggagagctacatcggatccattaataacatcacgaagcaatctgcttgtgtggccatgagcaaactcctgaccgagctcaattccgatgacatcaagaagctgcgggataacgaggaacccaatagccctaaaattcgcgtctataacacagtgatctcttacattgaatccaatagaaagaacaataaacagaccatccatctgcttaagcggctgcccgccgacgttctcaaaaagacaattaagaacaccctggatatccacaaaagcattacaatcaataaccctaaggagtctaccgtgaacgacacgaatgatcacgctaaaaacaatgacaccacatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21102 - RNA, 1254 nt, synthetic construct
  misc_feature 1..1254: note = mRNA product Design d-3 comprising derived and/or modified sequence from HRSV(Memphis-37)__AIY60641.1__M2-1 (opt6)
  source 1..1254: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtccagacgaaacccatgcaaattcgaaataagaggacactgcctaaacggaaaaagatgccacttctcacacaactacttcgaatggccaccacacgcactcctcgtaagacaaaacttcatgctaaacagaatactaaaatcaatggacaaatcaatagacacactctcagaaatatcaggagcagcagaactagaccgaacagaagaatacgcactaggagtagtaggagtactagaatcctacataggatcaataaacaacataacaaaacaatcagcatgcgtagcaatgtcaaaactactaacagaattaaactcagacgacataaaaaaactaagagacaacgaagaaccaaactcaccaaaaataagagtatacaacaccgtaatatcatacatagaatcaaacagaaaaaacaacaaacaaacaatacacctactaaaaagactaccagcagacgtcctaaaaaaaacaataaaaaacacactcgacatacacaaatcaataaccataaacaacccaaaagaatcaacagtaaacgacaccaacgaccacgcaaaaaacaatgacacaacataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21103 - RNA, 1254 nt, synthetic construct
  misc_feature 1..1254: note = mRNA product Design d-3 comprising derived and/or modified sequence from HRSV(Memphis-37)__AIY60641.1__M2-1 (opt11)
  source 1..1254: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatgtcccgacgcaacccctgcaaattcgaaatccgaggccactgcctcaacggcaaacgctgccacttctcccacaactacttcgaatggcccccccacgccctcctcgtacgccaaaacttcatgctcaaccgaatcctcaagtcaatggacaaatccatcgacaccctctccgaaatctccggcgccgccgaactcgaccgcaccgaagaatacgccctcggcgtcgtcggcgtcctcgaatcctacatcggctccatcaacaacatcaccaaacaatccgcctgcgtcgccatgtccaaactcctcaccgaactcaactccgacgacatcaaaaaactccgcgacaacgaagaacccaactcccccaaaatccgcgtctacaacaccgttatctcctacatcgaatccaaccgaaaaaacaacaaacaaaccatccacctcctcaaacgactccccgccgacgtcctcaaaaaaaccatcaaaaataccctagacatccacaaatccatcaccatcaacaaccccaaagaatccaccgtcaacgacaccaacgaccacgccaaaaacaacgacaccacctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21104 - RNA, 937 nt, synthetic construct
  misc_feature 1..937: note = mRNA product Design d-4 comprising derived and/or modified sequence from HRSV(Memphis-37)__AIY60641.1__M2-1 (wt)
  source 1..937: mol_type = other RNA
gggagagtcccgcagtcggcgtccagcggctctgcttgttcgtgtgtgtgtcgttgcaggccttattcaagcttaccatgtcacgaaggaatccttgcaaatttgaaattcgaggtcattgcttgaatggtaagaggtgtcattttagtcataattattttgaatggccaccccatgcactgcttgtaagacaaaactttatgttaaacagaatacttaagtctatggataaaagcatagatactttatcagaaataagtggagctgcagagttggacagaactgaagagtatgccctcggtgtagttggagtgctagagagttatataggatcaataaataatataactaaacaatcagcatgtgttgccatgagcaaactcctcactgaactcaacagtgatgacatcaaaaaactaagagataatgaagagccaaattcacctaagataagagtgtacaatactgtcatatcatatattgaaagcaacaggaaaaacaataaacaaactatccatctgttaaaaagattgccagcagacgtattgaagaaaaccatcaaaaacacattggatatccacaagagcataaccatcaacaacccaaaagaatcaactgttaatgatacaaatgaccatgccaaaaataatgatactacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 21105 - RNA, 937 nt, synthetic construct
  misc_feature 1..937: note = mRNA product Design d-4 comprising derived and/or modified sequence from HRSV(Memphis-37)__AIY60641.1__M2-1 (opt1)
  source 1..937: mol_type = other RNA
gggagagtcccgcagtcggcgtccagcggctctgcttgttcgtgtgtgtgtcgttgcaggccttattcaagcttaccatgagccgccggaacccctgcaagttcgagatccgcggccactgcctgaacgggaagcggtgccacttctcccacaactacttcgagtggccgccccacgccctcctggtgcgccagaacttcatgctgaaccggatcctcaagagcatggacaagtccatcgacaccctgagcgagatctccggcgccgcggagctggaccgcaccgaggagtacgccctcggggtcgtgggcgtgctggagagctacatcgggtccatcaacaacatcacgaagcagagcgcctgcgtcgccatgtccaagctgctcaccgagctgaacagcgacgacatcaagaagctgcgggacaacgaggagcccaactcccccaagatccgcgtgtacaacaccgtgatcagctacatcgagtccaaccggaagaacaacaagcagaccatccacctcctgaagcgcctgccggccgacgtcctcaagaagacgatcaagaacaccctggacatccacaagagcatcaccatcaacaaccccaaggagtccaccgtgaacgacacgaacgaccacgcgaagaacaacgacaccacctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt
